United States Patent 9,677,139 (GENETIC MARKERS INDICATIVE OF A CANCER PATIENT RESPONSE TO TRASTUZUMAB (HERCEPTIN)) - sequence listing, part 2

SEQ ID NO: 1 - DNA, 15429001 bp, Homo sapiens (residues 2,204,144-4,408,286 of 15,429,001)
aaaattagccagatgtggcgacgtgcgcctgtggtcccagctactcgggaggctgaggcagtagaatcgcttaaacccgggagacagaggttgcagtgagccgagatcgtgccattgcactccaccgtgggcgacagagcgacactccgtctccaaaaaaaaattaaaaataaaaataaataaataaaaatattctttaccataagaccagacagtaaatcactggtgatgttacaatagaggccattattgtggagtgcaaaagtaaataacgagaacagtttctattcatctttagctggagttgctcaccttcctgagaaggctgatttttttcaggtcagacaaattgaggaaacagttctacaacttaaagaaaaaagtgttatagtttttttttttacatcaaaaaattgtctctgttatattcagaattttggaagtgttggaaattttagaggtccctctagtagagcttttctcaagagacacaccaccctggggatcacacttttataattttcccctctaattatggtggtgtttctcctatatcccccactacttgcaaatgtctctttgtattaacggtgacttagttcacctgctgtctctcccttagctaggggtccgtggaagattagacaggaaaaaaaaattaattattcaagattttcttaaataatttgtgtaagaaaacataagaataaagatctatcacttcaattaaacaatttcttccctaatattcctgagaaatatttataaaatttttcttggaaatactagcaaggaggtatttgctgttttctcaaagcagtggctaccatcttggggcagttctaatggctagaaattgccttcttttaacttcttctggtcttcaatcttttgttaatgatcttctggagacattaaaaggcattgaatatactggtgtgaacaaatcaaacatagttcttgccttcatagagcttacaatttagaggaagaggaaggcattaaacaaaacactcagaaaaataactaacccagatgtcaactggggcttcacgttccttgagaaggactgggctcgaatcttattccactctccaagggtgatgtccagaatctccccctagattgcggcacattgcggatgcctttgtggcattttgtccctagaattgagctcctactttctctcctactgctctgcagtaaatgatgcagatgggacagataacgcttttccttaattctcacttacagaaaaataaaactcacaaagcacctctctatttgagaaagattctaaagaagaattttaagaaaggcaaagggtaattttgcagtgcaccttggaaaatttcttcaaatgaagcattatttacagaattgtcttacgactttttaacttgactgaaatttcagagagaacggggcagagctggacggtaccaaagcgtctcttgctcagcagcctctgttatgtatgtgtgtgcataatgtctgcacgagggggtgtgtggaggtgtttgttagttatcactaaaatgtaattgaaaataatgtacacacaaaagaagatgtattttatgtatacatttgaattataataataaaatgtcaaaattacattttaaaatgatagtggtacaggtttctcctggtatttttctcaatattgtctttatacattttgtggtaggctactagcagcattcaagtttagagtttttgtttttgcttttgtgttctgaaacttttataaacagcatggccaatctatgagaacctttatctaaaattttgtttggggttatttggttgatgcaggtaatatgagcaatcactcctagctcaagtgactgttaatttacatctggcaatttccatgagggacgtttctgtttcgtcatgttattcttcatgagggtcaacagccaagccatcctctgtctaattgagatggttgttcatgtttttgctttgcctgtttcagccactaaagttctcctttgaggggtcttgaattcaggcagggatttttgcccagtctcacattcggctgaggcctatgcaattgatcagaaggtctttaacacacaacctcttgaatgccagataacggcagatactcctagagagaatacatcttccttctaatttacctttgtgatttttgttttcttgccttatgtaacctctgcataactcctgtggtcttgctactatcttggccatgtttaaaaataatttttaaaaaactgtattaataattaatatatattaatgtgttgtgtgttgggtcactctcaccatatagctcaccatttttcaagaaatgaaagaaagtccacatgtatccttttgtctactgtcgttggtctttctcactgacccttcacacatccggtcttaggcttccatcatcattgagtcttcttcctcccttggttgccgaagtaaattcctttccttgatccgtgaagagtcgtgtgtgagtcttctttcaagatgagttccagccaggcccttaggatcacctggcttaggtctttccctacaccttaccaaaccaaaccaaactaagccaaaccactctctaagctaatgctagagccaccagttaaaataaaatttaacttctcatacccatataagactcataattacaaataattatacattctgtgaggaaaatcatagattttcatggcagaaaataacgggtgaattatttggtttggtggatcgtggaaaacctctttgaaccaatactttattttgattattctggaaaacctggaatttatgtaattcctcatctgcatatttgaaattcaagtatccaaagtcagcttatagttttgttctttcctctccttggaattgttcaacttttcttgaacaattctgcaaagaatttcctaaccagatagttcacaatcctagtcacctgagctggaaatacactaatatttatctgtttatgtaacatattcagatcaagcagaaactcttgaatttggttattacagaaagcagtagaattatactactattttccttgatctgtaaactctgttttcatgaatacagccccaagatttcttttacttttaagctgatctgcaaagagtttttagtcaattattcataaggtttatagcaatttattttataaaactaaattctataaattatcattaatatcaataattatgtttgattacatatattacatgaattattcatctcagatttgtgatgtctgaaaattaaacatattttgatatttataagaactgctaatagactgatataagcctgaaaagtaagacactttgtataatgttctatagctaaacatgatcaactttttctcctttttttcacgagtcatcgtaattacttggatacaaagataaaatattttaaaatgaatatcctttgtatggccatttagctaaatagaatctatagtacttatgttctacttattttctagctagtattcttttgttagatacagtaatttgtaaacatttctgttaaaatgcatggatattatatacagtggactgagggcttgtgtttcctcaaaattcatatgttgaaatcccaacccctcaaagtgatagtattaggagatgaggactttagaaggtagttaggtcacgagggtagagccctcatacatagaattagtgcccttatgaattagatcccagacagcaatctagtagtcttttctaccacatgagtacatgtcaagttggcagtctgcaaccaggaagggtgccctcaccagaacccaatcatgctggcaccctgatttcagacttttggcctccagaactacaaaaaataaatttctgtttttataagccatccagtctgtggtatgttgttatagcagccagaatgaactaagaaattttatctatctggtttccaaaacctcagtatattacatcgatccaaaaaaatatgtgtgattggcttgccatgtcttgatttatgcatatatccttctaaggatcatttttaattactaatattttgtaatcattaaaaattagtgtgctcaccagcaaataggttatacaaagagtgctggaaatattccttcaaaaaccactatttcagatttatgttatgttcaatagctgtcttttaaaaaaaacaattattttttagaagtgtagcaaaaaaaaaaaaaaagaaataaaaaaatgtggtcagattcactaaacagtgaatttaggattttatgagattatttattctgtttagtctatcattttttgaataacagtttctacaaaaatagagataaaataataaactttgaaaatcactgttaatgtgactgatgatttgactttagttaaaatgttacctttactataatagattaatatcgaatcaccataataaaaataaaaactttacaagcaaaggtacttgctgacattaatagaatgagctttcatttatattgtgagtttattctcttagggtgatgtttgaaagagagtccaaggaaatatttaaaatttccccccttttttaaatttaagaatgcctttcttttaaatatgtaactgatcagaagtggttttttaggtgaatattatcttagtttatgataaaataataaatcttaggattttcaaatgaatacaaatttatctatatttcgtacatgaattcacaacattaacatatcattttatcatgtacatattaacaatgcaattttccctttacattactttatttctggaaaagttgaaataattgccagaaatacagaaaatttagtcgtgttctttttgtctgttggccaatatatcacttagttgtcgggtagtttatgaaatggtaatgaacattttactttattctagtttaccagtaaactgcaccataaattcaacttccatccacacaattcatcattcacatggcgtaatgtgggtttacaggtgacaaaaaataattaggctagaaaagagtaactatgttttacaggcttacagtttttactgaaacccatttgctgcaactgtgatgaaagaaatacagactttgagaccctgaactactctatgaatataagcaatggtgtattataacaaaaaatatgaaattagtgtgtttatataaattatttaagtcccataaaataaattattttatactattgtaatcagagcagtaaaagttggcaagtgatataaacttagcttaagttatgataccactgaaatattaattcttatttgatacgttttacacaggaccaagccaatatatcataaatgataaagcgtacatataatctaaagtaattaataatttcaaacatttcattcctactctaatgacaacaatgataacaatgataatgatttggatgtaatggcatcattgcatagataagtgtaccagaactttttcataagtatgtaattccacagtgattgattgaattttattaatcacagcacaatattttcattgaaattttggcttttggtcataaatttcaaaaaaaattaaattttggttagacactctgctatgactatgctgaaattaaacatttgaaaaagtaataaagcaaataaaattagcagatataaataaaatgaactgccttgttttctatgatttccattgttggaagatataataagatattagctgattattttacactgaaatcatgcagacaggtcattcctttctatgtgccaataagagtagcttgaaaatatatttttttagttgcctgaagaaaagcagactagagaaagaagtataaaagaaccaaatattttacctggtagagtagatattcaacaagttacccatgcacattccaaatacatcgaaattagatatggagaactgaaactataatttatagatgccattcaaatgcactacatcttataactatagcattattccaaagcacattttcttcatgtgtagctgaactatatttcctatgcttggaaaattgacaaaatttgtagaaaataaaaatatcatgaaacattggaataaatgcaaatttttccatagaataaaataatacctaattaatgacagatgtttttattgcggaagaaagtatgcagacaaatggttactgttgaaataatttgcttagacttccatgtaattctgcagtactctaagataatttaaatttaacttagaatgtaaattttggaatggataagatattcatttataattcaataaatacttgagcaccagtttcaggcaatgttgaaagtacttttttaaaaaaaataatttccataggtttttgaagaacaggtggcatttagttacataaattctttagtgatgatttgtgagattttggtgcactcatcacctgagcagtatacactgaactcagtttgtagtcttttatccctcaccttctttccaccctttcatccagagtctgcaaagcccattgtataattcttataactttacattcttatagcttagctcctacttataagtgagaacatatgatgtttggtcttccattcctgagttacttcacttagaatgatagtctccaatctcatgcaggttgctgtgaatgccattaactcattccattttatggctgaataatattctatcacatatatcatttttgcaattgtgaatagtgctgctataaacatgtgcgtgcaagtatttttttttttctacaatgacttctttttctctggtagatatccagtagtaggattgctagatcaaatagtaattctacttttagttctttaacaaatcttcacactgtttgccatagcggttgcactagtttacatttccaccagcagtatagaagtgtttcttattcgctgcatccacaccaacatctattattttttgattttttgattatggccattcttacaagagtaaggtggtatcatcagattgtggttttgatttgcatttccctgatcattagtggtgctgagcattttttcatatgtttattggccatttgtatatcttgttttgagaattgtctattcatgtccttagcctgctttttgatggaattgtttgcttttttcttgctaagttgtttgagttcattataggttctggatattagtcctttattggttgtatagattgtaaagattttctcccactctgtgactgctgactgtgccttttgccatgcaaaaactctttagtttaattaagtccaacctatttttctttgtttttattgcatttgcttttggtctcttggtcttgaattctttgcctaagccaatgtctagaaggagtttcctgatgttatcattgatttttctctagtgttttcctctttgaaacgtgatttatttttaaaatcttatctttataattttattctttctgcttgctttgggcttaatttacttttatttttctacttcctgaatgtaaaagtttagttaattagaagttttttaaaaaataatataattgattgctataaatttccccaaaaatgctactttatttgcatatcataaattttaattcatggcatttcaacttaattcaaaatatttcataatttctttataattttctcttatatggttttttttaaatgtgtgtcatcaggcctatatgttttttagaaatgtgttgcctaatttttaattgtttacagatctatcattttctgttactgatttctaacacaattctattatactcgggaaatacttttttcaaatacttctaattgtgtagggcttatattatatctttcattctttacttggtaactaatggctccaaaaatgttgcactgctttgtatgtagtatgagaatcttataactaaatattcctaatcctcatctcccatgttttgggttactttttaaattacatttttgcttttatttataaactcacaatactactttttttaaatcagtgctcaattttctattagataaattaatatatcaaaatatttatacttatattcattttaactgttaatagtgatctttattaccttgtttacatccatatatgtatgtgtgtgtgcatctatcatgtacctattatctgtctatctatctatcatctatctatctactgaaatttatatcttctatcatattctttctgcctgaggaacttgcttttcttgtctagtaatcaatcctctcattttctgtttgtttaaaaagtagtcttaatttttccttcatttctgaaaaatattttaacagtatagaattctgggttgatccttgttttcaagaactttaaagatgtttctgataagatgtcatttgtaacttttacatttgttccactgaatgtaattatttttccacctctggctgtttttaagattttctagttatcttggttttcatcagtttgaatatatttgttctaagtatctgaattggggagcttggtggtaagaggtggatttctcctgcttggtgttatttgagcttcttttgtcgtggtttggtgtcttgctttatttttgaaaaattcttggtcactgcctcttcaactatttcttctgtcttgaatcttctcagattccagtcacagataggttagaccttttgatagatctgcagtggtataccctgcttttttacactgtttttttcactttgtgttttaatttgagcagtttttattgacttatcttcaagttcattggttctttttttgactactgataagcccatcaatagcattctttgtctataaacttttctattccagataggacaatttattttagttttcatctctgctaagattccctgacagtgtatagttgtccattttttcaactggagcatttaacatatcaatcataattattttataatccctttcttgtagtttggatgcctgagtcatatctgattctaatgttattgattgatttgtctcttgacagtgtgttgttatttcttgcttttgtatgtgtgtcttatgatatttgattgattgtcagagccatttgttgagcagtagagtctggggtaaatagtatttatttctaaaaacaggcatgtctgctctttagtgtgggggagatgagtcagttcaatcaggaattgagttggattcacttttgttggtctttggttaccgctggcttcgaattactctgaacttaccttgtgtttttggtaagggtcagtttgctaaaaggcttttctgaatgttccagctccttgctccctgtgtttctgaggttcagagatgctgtatcctcaatgtattaccaggtgttgtttgttactcagcacctactagcctgagtggagggaacagagctgtctctcttgccctggttcagcctcaggcttaggcagaacctcctcctttgttctcaggaaagtgcttcctcaataactctgctcctctcccagcagtggaaaatctccaactaggtattttgtgtttaccattacatttttctcaggcagagtgtcacccttgtgctctagctggcaacaagcctttgctgtcctttccctgggctctgaaggctttttgttccttagaggagaggaaacctgatggggcttcatgcctttcccctagtactggccattcccatctggctctccatgcaaaggaagagtgtctccaatctctccccttgccctcagttattcccatatgggagaatctgtaactgggtgtgaattcctcccaagtggtctgtgcctcccaaagctctatactgtcacccaggcctgcacttattcttcagcaattcattgacgttttacctaaattcttcttgcctgctcatattgagacaccatcttcccatctttcaatgctgctacaaattactggtgcttgtgtcttttatctcctaagaggcatctgtttatgtttctttgtttagatttcaggctagcaagtagtcctatgagcatctctgtgataggttcaaaatgagttatgattttgtatattatacagacttttctagttagaatggaaaccaagctctttgtagctttctacattctagtgtaaagctgaaacaaccccttccattttttagtgcataattttaaaaatcagcagcatttttcttccatattacttcatataatatgcatatcatgcaaccttatatctaccctaagacaaagcagcatattggactgtatcaagtaagtggcactgccatgctgtacattgttggacctgcttcgccagtacactgttctgaatgattccaagaaatagaactaattgaagaaagatgtcttacctgtcatttcactaaaagcaactaatttggctccattcagtctattattttccttactaattttattgaaattctccttccactgatttggcaaaatattttcagcaatgattaatattaccgtgcataagaaaagaggtcagaaaatctaatctagactgacatgtcaaaatgaggataaaacaaatgcaaaaaccattttacgaggttaaaatttgggtggtaaacccagtgaaactctgttcctttcttgtggcatatgcctttgtctgtgttgttacttatttgataactgtctaatatcacctccacacacacacatacactcttatatgttctccagctctattataaacagatagcatcagaactgtgtaattttagttcccaacattgcttcttgctcattttcaataaaaaggaatttttatagtaaaaaaatttaaatgttccactcagcttcaaaaagtataccaaaatacctgttgcaattactgcaaaaaataggatcaactcaactttttaaactgataagattgaaagaaaaacttttttttgcaaatcttgccacaacacattgctgttatttagattaaaaatataattctagatgaaacaggatttcaaaagattagaaaagttggcagaagataataaacctggtaaatttaaaatataagtttcaacataggaaagcatttttgagcaaagatatgactaaggaggccaacaaactggacatggttatgaagtctatttatacaacaaggtaaaataacgtgatttttatgttacattcacttacacaaggacatgataatttccatgtgactttctcctgaatctgcagagcaaactgcaattttcttggattataaactatgtttatataagaaaactgtataactaatggggtatttatttttattgtcagtgttttgtatatgacaatgtgctttgaatatgttttaaagttcaattatcatcaataaagatgaaaagatgcatcccctaaattgaaaattatacattaaatacatatttaaatctctcatcaaaacactaccttgactgagaagaaagctaatgattctaggtacgttttgctttgccaaatactatttgttatggctcagtggtgctctatcgttttgcaatgtatcacttcgtatgcagaacataattccttaaagtttctatttataaaagctaaagatagaaagtcttatactttatagcaaatgctagaaagtgaacatagataatttaaaatgaatgtttttgccccttctcctttagttccttaatatacggtggtttctaagtctgtattttaaatgatttcagcactcctattttctatgttacaaggcaatctgcctgtggtagaaatagtaatcaaaccttgaattctatggaagggttactcaagtcacttagaaaaatatctctgagactacacagtgttgccatattcatgctaattaaaggtcaacatggcattaaacatgtaacttctcaggataattaaaaagagaaaataaagcctgggggtatgacaaggaataaatggagtgtggtatagtcatagtcatagcagaaagaaaaaggaggcccaacggcccctccttgttctggctgagattccaacccagcattaatcatctcattataaccacttcctagagagatgactattcctaagtaggaagacacaaataggtccaattatccacctctttctaaacaagttttaatttcacaataatttatatttgtacttacctgtacaaaaaaacttattcctccacatctgtgtcctcaccccctataagactctataaatcctctaatttgatccaaactcttatctttctctggtaactccaactccattgatggaaattagcattgtatcagaaaaatgaccacttccctaaaattcctccagttaaaactaaacatgttttaaaatttttgttttgtttttgtttttatcctgaaggcattattcttcctgcaggactatgaagttatggctacattttcttcccaatccccttctacccctaaggttgaatgtgggacaggtgtcctcacagatccttatcaccaccactatttcccagcaccttcaaaacacaagcaattaaatattgccatctgctacaatttcttattgcagtcatctatttgcatgaaaccactcttttccattcagttgagaattttagcttttaaatccatcttcctgtccatgattattcatatcaaaatccctgttagtttcagtgtttacctggccccttcctgctagacatgtatacatctgctatgaaaacattacaaagtatgcctatatgtatgtagagaacataaaggaatctatatctttgtttataaaatattctcaagtattgacaaagccagtccttattctatttctataaaaggtagcagatttggactcatctaaattatcaagcaaaatgtctaacacattttaggtcattaccttaaagaaataaaagattatcagggaggtgtgtttactcagttactttcttatcccttgtatttattgctcgcagaatatatattgaaatgaagaaaaatcagctttgaactggatctaagtcatccttcacactgtctcagaacctgactcaatttagtgcctcagttatttggccttgttctgtcctctccaaagaacatttcctctatgccttctctgccacacccctggggtcacaaccatattgaatattatcaatgattgtgccacctcaaaaatataaatttcaaactatttctcttactagtttctactatcttcttagcccaatgttctagaactcatagtcccacaattttcaaccccactgggcactctcatatactgaaccttacacttcctgtggtctactatgtactacaaatagtaaaatccatttttacctgacttagagttcaaaattaaaattagagccttgaacaaattatcagtctccatacctttctttctgaagaatttaatgtgtcataacccccagccctagttctatacaactttctgccttccctgcctttcaacctggatgcatatgtaatgcttttctgactttaaattcatcacaacttcaagtgtgctttcagcctcatcctaaaatactgttgtgttttcatagatcatttgctcaccctctctgagacggttactttaaatttctcatgtctttattaatattaatccaaaacatttcctttccctactgtcagctgatttttgactctaagaacattttaaaaaaaaaggagaattttatcaccatacctccaaatctattaacttacctgcatttagatacatgtcctctgtcgggctccttttttaccaaaagatacactttccatgtctccagcttgggcaaagagcgagactccatctcaaaaaaaagaaaaagaaaaagaaaaaaaaatctaagtgccattctctccttcctatgaaagggcttaactccacattttatttctccagttgcatcagttttctacatttgagtggctctattgactcaccaccatcagtgtcgctataacagtattcattcttattaaaaaacacccatattatttgcagctcacacactgctcctcattacagtaaaatactggatatgacttgtttatacttactgttttaaattcttcccattatattccctcttgctaccacttaaaaaactctcattgtaaccacaaaaaaatagatcttaattgtcctttcactaatatttaatagggttttaaatatttttccgtctgtgatcaattcttcctttggtaaaatgatctaatccttgttgttaaataccatctgcataatattgggtcccagtttgtatcttttatcttgacctcctatctaaagttcagactcacttacctgactgcttgctctcttattctgttttggcattttaatctcaatatgtccaaaaaagagtttttaatttccaattcatccagatatttttctttgacaatatttccagttataatcaatggcaatgtagtcaactacttactcaagccaaagtctctgagtcattcttgactattctttcaacatacatttaatttatcagcaaattctgtcatctttgttaaaaatacacatagaatatgaatatctcttcccacttatgtggtcttttctgcttccccttattttagaaatatattttgccctttcctttttgttgggtagcagcatgtctggtggccacaaaaattgagggagttttggacgtgcagggaaggctgtgaactgggagtctggggcacgcagggaagggtgtgaagtggaagtctgggacatgcagggaagggtgtgaagtgggagtttgggacacgcagagaaggctgtgaaggtattgtcaggtagccctggtagggggtagagtgcacctgaggctggtagagatagctgtcattctgccatggttgaaatattggttgtattaaacaaacaagtaaataggtcaaggtgacaggtttctcactgtgtagaggaataaataaatataagactatatatacatatataaatacatgtaatcatgttaatagctatactttctatataaatgtgtttattcttggttcattatatatgtgtgtacctataatattcatattacatatgaatatataacatatggatatataacatatgtaatatgaactagagttccttggagaaatgaataattccagcactaaagcaagaaaaagtcaaattgagtctgcagcatcttgttatgccaaaactaagaaatgctcaaagaatcatggcaatttatcagaaagatacagaagttatcaagaagagattcctaatgacaacatttggacaattagagcatcaaggaaaatattacattaaatagaaattcatgtatccatatgaaatcaatacataaataaatagatgagtaagtataaatggtaaataagggaaggctttgctttcagccagccacaaaacagagagtcatcaatgttaaacatcagaatggtgactgattgaggtagttgccatcaatgaatgccaatgctggacatttgatgagggacagaatatttgcaatgtttttgaacctgttatcacattgtgcttcgttgatcgtaattttttaaaaaatgatgagttgtggtgatgtttggcagacaacaacacaacaagaatgcatgacctgagtctggtcagaaggaaatatcaggtggtcacagattgaaggccaaaccttttaaaattataagaacaggagggatatggaagaactgagaagctttacagactaatggaacctgaagagacaaaacaaatgactgcagcacatgctcatgaacaggactctcaacaagaaaaggaaaagagccagtgttgcaaggattgatggatttgcatggcatttcttggttggatggtagtgtggtatcagctttgatttccagctttggaggactgtatgatgattatctgggccaatgttcttgtccttggaaggttcacactggagcatttggggatgatgcaacaccaagttagcagttttctcacaaatgtttccaaaaaaagagtaaagaaagagatgcagtaaagcaccaacagtattaaaataaattatgaagaattatttaaaatacatagataagttaaccccaaccaaagggtaaagaagaacaaagcactctgattaattatatgtcaattatatggtaaatacttgatgtcggttatattgtaaacacaaacaacaaatattccattcacaatatagaagtgtaatacttaaattccaataataaaccaaatttgaataattacaccatcatgctattaaccttcaaaatcaaactctctatactacttctctagaccaagattaaagcagtaggaatacaaagaatcaaagatacaaagcaaaatcacacgtaactattcttttattttcaaaatgcatttcttttgtttagatagtcaggtaaatgtatttactcaatttggcttttctttgatggtctacttacttataatcaaataaaaatgagcttctgtgttaataatgaggatgcaggtggataccttagaaatgcaggtgtctgaaatgaatgcctaaaatgtcagagacatatgactcagctgctgtggaagctgtcagtttcctttccagctggaatcatattggaatgggtaattactgtaacactttcagcaagagacagacatgtccctgtgaatatcagtcatcaagtggaaattcccagagaatctgagtcagtgccatctaaaaggaaagttctagaaaatgaacagaagtctctatatttttccttttattaaaaagaagccttttctatagttagcaaaattcagttttctttctacataaaaaattacatgtttctgaaaatcatgcctttttaccttctatcaaacccacttttccttctttttgatgaacaagagctattataacataattttatctgctataactgaggcccattagtaaattctgacagataattatctaaatcaatgagtattttctttttaaaaataaatctggctgagtgatattataagaaatacattgccaaatcgtgacagccatagactagtgagaaatacgttccaagttgctttcaaattaagtcataaataggcctgtcttccttaatgacataagattagatgatgatttaaacaaacatttattgaatactcactcaatttcctcatctatacactgtggataataacagcacatactttatagagctgtggataaaaatgagttaccacacgttagtaagtgcttaatataagatagctgttattattaatattatcatactagagataaaatatatactgcctcttcttgagagactcacagatttatatagaaagtgagttatccataaattcacataaaatattttaatggtagctccactctaaataagatatcccagataaataagacttacctgagggatttaaactgcctaaagtttttagtttttctgctgaaaatagtagataagtggtttatggcactgaattgagaaaaaagaaaaaaaaaggatttgtctataaaaagatccctctagagcctgtacagaatagataatacaggtagaagagaagaaaaatgtcttagtatatgaacagacacttctcaaaagaagacatttatgcagccaaaagacacatgaaaaaatgctcatcatcactggccatcagagaaatgcaaatcaaaaccacaatgagataccatctcacatcagttagaatggtgatcattaaaaagtcaggaaacaacaggtgctggagaggatgtggagaaataggaacacttttacactgttggtgggactgtaaactactttaaccattgtggaagtcagtgtggcgattcctcagggatctagaactagaaataccatttgtcccagccatcccattactgggtatataccgaaaggattataaatcatgctgctataaagacacatgcacacgtatgtttattgtggcactattcacaatagcaaagacttggaaccaacccaaatgtccaacaatgatagattggattaagaaaatgtggcacatatacaccatggaatactatgcagccataaaaaatgatgagttcatgtcctttatagggacatggatgaagctggaaaccatcactctcagcaaactatcgcaaggacaaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacagcaacatggcacatgtatacatatgtaactaatctgcacattgtgcacatgtactctaaaactgaaagtataataaaaaaagaaaaatgtcttagaaaaaaataaaagagagaaagtgtgtttataaatggttagttgtgaggaggaggcttttttttttagaataaaatgatactgaaaatgatagctagttaagtgaataatttaacttagacggaaagggcttgaacaattcatttaaaataattctgagggggtactacctagcttctatttgagtatttatcttgtcattacatagcatgggactttgatagatgtgataaacatggctatttatcttccctcaagtcactgaccaaacggttcaacaaggcaaagcagaagacaaccctatgtggaatgtcatgaaggtgcactcattaatcaatctttgagtattacagtggctcggtaactaaaatgtacccactgtaagtttatctactttacaaatattctcttgctcattttggccactcaactattattcactaatgaactaacctctttctggagttcttcatttgtcacaagttatatataagggaaacagtggaaaacataattcagaattccttcagtagaaaacatttgagttgatccactcagaaccacaggaagaactacagcaaagtcagtgataaagtgctttttgggtgcttactctactctgttttagattctggattgcaaaggaaaggccgttggcatgaaacaatttatgatactatctcattaaatattatttatatgtcacaacagttctccaacattttcaagaggagcaaatatcaactttactgttctcactcattcagtgaatagatgtaaaagaaaggctatgaaagaaagaaaatctttattaattttctattttgattcaataaatgcaaatatcatttagaagtattatgtcacatagcttcactaagggattgaataaaacagacaccaatagttgtatttaacagataactaaactgagaatcagaaagattaaatgactcgccgaggttacattgcttttaggtggccatttggtattcaaaagctagtttttgtgaattagaagctacattgtttacatcaccctatatcccaaagtttaattgcagaattggagaagtgctccaggttattgaaaaggatggacatttgtcatttatttaattcattaatatttgaatcctcatagtgaacatgcggagctctgtccaatgcagagctctgcccagatctactcaatgtcctttcataatttctgtgtgcttcctggtttctgaaagcctctgcattgctctctagtggcttggacatgcaactctttttcagaggtctatcctcaggctgagatgcttcctccttatttacagaaagctagaagtgcctggaaatgtatattccttcagggtgcagtttttagccaatggctgatgagttggggaagaatggaaaatctcagctctcttgtcttgaagttataaaatgtaaggtaaattttattctgggtggccctttcatatgttatgatctgagtgacaggagagtctctggacccaatggatcccacaagccaaggcagaaaagcgactggtgggttcttggtcttatataaaacatcagttttgttttttttttaaatgttcacttctatgtgtcattcaatttatttctcaaccctctgccaaacgagtgctggtatgtccactttattttatgtatgccactgttgttttacaagttcctggaaatcttgcaaggtaaaaaccttgagtcatgtatgagtgctcccatattaatatcccccatacccaaccgggtattctaacactttcactacccaacatgaggttgttttctgtttctacacttctgataaataacccctcttttcaccccttagcagagacactaggttgcaaaaagccaacgtttggttttattgattatctctattacttttctacttcactgatggcaactgtaattaaaaaaaaaattcttccttacacttgctttgggtttcagttgctctttatcccatttcttaaagtggaagcttaagttatggttttacatctttattgaggttcaacaattccttcatttttatgtcacatactttaaaaattttaaatgaagataactgacactttaaaaagcttttaatcattatatgttaacatcttaattttatctaagcatttatttctatatactggtttttagataatgttaattttaatttcttctggaaggtaggatttgggatgattctgtagtttagccaatgtgcatttatcattttaacaaaaagttatgtcaaattcaaattaatatagaaatgtgattaataatagaccttatggattcaatgtttcagcttgttatctaatcgaaataatatagacaatagtctataactcaattacttggggaaaatttttattttataagctaaagaatatttccaaaaatatttttacatttaatgatctatgatacatgtctcctagttatgagccttttagaaagtatgatcagcttcttaaaaattatttcaggcagcttaatattaataataatactaaattttttaattaaaataatataggagaccaccaaaaagacttaaggtaagtagttatcatatggtgttttgggtgaattaattagaagtcaacatttatttctcttttttatatatgtaaagatatatgaaagaatatttttaaaaatttcctgggaacaaagaggaaagaaaaatttgttccatgtgtttcaatataaagacaaataaggcacagaaaatacatgaagtaatttattcctataaaattttgtatatcggacagaaaaacttttatactgatgcttcttatacatagtatatataaaagcttatgccataacactgagtcaaaaggttgtcatttcccccttaaatattacttacaggtttatagtccaccttgtttagaaatgatatgaataagtatattacagtaataatttcttaaataagaacacaaagtaaaaacttagaactcttatttcccttgtctttctatgactctttaaacataaaaaacttgacagacaaagcaccttctcttggaattttatgtaacctgaaaaaaataagagtaagaaattacatagtgatttttaaaacacaatcccaaatttctaggtactgtaaataccaaaataacagaggatacaataaatccctcagaaatatagaaccacaaacttcccttgtccattttgttgtatagattgctaatgatggtgaccactcagagctgactagatttaattataatttgtagcttaaacaatatttgaaaaaggatctttcaagctcaaattagagtcaggttattttcttagctctcagaatctgaaggacatcatagggttaataatctgaaggttctcctgtcaaatgtggtgtgtcttttcttaagtcactattgaacttctgaagatccacaatcataaaaatctgcctcttgtaaactgtgacaatttagttctatatactctctttggataatgaaatatactaaaatatttgcttcaaattccatctatataatataacggttcatatatatatgtgtgtgtgtatagatatatacatacacacctaacatagaaacaccaatatatccaaagcctattgaaaatttccatttggaaatcttacagacatgattaactaatataaatttttgcctaaaccaaataaactaaagtctatatgaataaatctcagatgagctagaatcatgagtctaaacttgtataaattaaattgtttttattctatatgttaacatatttatatttggaagtttttatattttactgtatttttctatcctttaaaacaagcttgtccaacctgttgcccgcaggccacgtgtggcccaggacggctttgaatgttgcctaacacaaattcataaactttcttaaaacattatgagatgtttttgtgtgattttttttttagctcatcagctattgttattgttagtgtagtttatgtgtagcccaagataattattcttccaatgtggcccagggaagccaaatgattagataggactgttttaaatagtaatgcattttttttcagataattaatctaataacacttctctcttaattttaagaaaaatcaaattttgagctactgtgatctaacaggaaaatgaggctatcaaaaattggacatgtgcaaaaaaagaaacagtcattcatttataattaggagaacaaatatatattagtacgcctttcctgttgatgaattcatttgctactcttccagactctgtgctatgctaggacccagagctagaagagctcagcttctaaaaagtcaagaagagcaacttcaagattcagaggaggcttaaaaggcaaggaaaaatattttcttcatctgggataatcttgtgtttaaagaatgtaaatacttctttctatgtgagttagaaattgtagaaaataaagttaatgagttagttagtataaagtggcctaaaatatatgaaaggttcaaaaattgaaagatacgttaacagttacaaaaggaaaaaacctttcttctatgtatgagatgtaaatatgattaatagaacttttgagcgaacagatcattaggcaaattgatcattaattaactggcattaagcaaatttgttttaggtggacttgctttcttctaattcaataaatctgaaacctatgcagatatttttatttgagctcagtttcaaaagtagcacaaaatgtctttgtaagtgttgagctttttttccatattaaaataaggaggattgggtaatagccaccaaaatgtcaaatcaagtaagtaatttaggttgtccttttcacaaactcatctgaatgatacatttctttacaaaatgaaatgtaacacatggggtattttcagataatttttgacaagccatggtaccaagtctacataatttttttagcataataatgtattttcttatcaaaatgtcattaaaatttagaatctcagcaaaacatgtgtgaaatactttgtaatatacactattcttaagaagaatgatatatttcttctgtgtcctatacaatttaactattctcaaatagattggccccgtttatgtgcattaatttaatttagttttgagacatttgtggtataattatagttaggtcttattttcctcatttgcctaaacacaaagttcttattttaacaaaccaaaaacagaccacccatattgtagacttgaaatctcattaacacagtgcagagctagagtccaacatacaatatgagtgtgtatatgtgtgtctgtgtgtgtgtatgatagaaaaagacagaaaaagacatagagattgacagagaaaaattaagacctgaaattttcagggttacctaaatattcactccagtcattatgtaggagggaatataatattcctaaatcatgctgcatttgttttctacaggatgctttctctgagttaattaattcaagatatacgttcttactgcccactttctaacattttcactaaaagaaactgataattcaataatgaataagccacagatccttccaaactgaatgctatacagcttaatataatgcagcaataagaaacatgaaaaaaagaactctaagtgcctgaaacatacctgtgtgattagaccttattattccactgtttctggaagatgttgtatccacttgatctgtctacttttaatgctaatcttttaaatgcaatgctcagttagtgtcactaggttcaattatccataataatatccaaagctattttaaagtaatgattttataaagccagaagaaatgattcatggaaaatatcacaaattattatatgaaataagaattataaacagttaatttgatttaaattatgtatttagaaagctgtctgtactatatttcctcactaataatctctagagtttctatgaaagatattgctatactgtcccgctcctttttggttactctgcttttaatacttcttcaagaaatctgtgtttggatgatctgcttgaggttgctaagaaaattcccaaggaataaacaatggcagatgaagatttgacttttctttttgctcatgagctgttcaaaaaactagttctttgcatcattgctttctattcttcaaaataatataacattaaaatataaaatcatacacatttaaaggaataaaacttcgcagagattaatttttatctataggccaaataaagctaaaattgtagagaaaaatacagctagtcaaaaccataaggcaatataaagtgttcagtctgtttttactgaaggatataaagtgaatggtgcttcctaagcaatgaggtttgaaagcatttcgaggaaaagattgattttcacactcaatgtttgtaaatggccttttggaagagggaaatcaagccacatcaagtcataatatcacaagacaactggaatgtagctgccaccacaggacatcatgaaaaccctccaagggtagtgtgatgcctccagctttgttatttttgtttgggattgtcttggctatatggaatctttttttggttccatatgaattttaaaagtgttttctaattatgtgaagaatgtcaacggtggtttattaaaaatagaattgaatttgtaaattatttgggcattataggcattttcatgacattgattcttcatatacacgaccatggaatgttttttcatttgtttgttgtctctctgatttccttgagcagtggtttgtggttctctttgaagaggtcctttacttgccttgttagctgtattcctaggtattttattttctttgtagcaattgtgaatgggagttcattcatgatttggctctctgtttgtctattgttggtgtataggaatgctagcaatttctgcacattgattttgtatcctgagacagcttaagttgcttatcagcttaagaagcttttgggctgagaggatgtgtggggttttctagatataggatcatgtcatctacaaacaaagataatttaacttcctcttttcctatttgaataccatttatttttatcttgcctgattgccctggccagaacttccaatactatgttgaataggagtggtgagagatggcatccttctattctggtgattttcaaggggaatgcttagaacattcatgctacctgacttcatactatactacaaggctacagtaaccaaaacagcatggtaccagtacaaaaacagacacataaaccaatggaaaacaatagagaactcagaaataagaccacacacctacagaaatctgacctttgacaaacctgacaaaaataagcaaaggggaaaggattttctatttaataaatagtgctgggagaactggctagccatatgcagaaaattgaaactggaccccttccttacacattttacacaaattatgtgaagatggattaaagacttaaatgtaaaattcgaaactataaaagccctgggagaaaatctaggcaataccattcaggacataggcacaggtaaagacttcatgatgaaaataacaaaagcaattaccacaaaatcaaaaattgacaaatggcatctaattgaactaaagagcttctgcacagcaaaagaaactatcatcagggtgaacagataacctacagaatggaagaaaaattttgcaatctattcttctgaccaaggtctaatatccagagtctacaagaaacttaaacaagtttataagaaaaagaaaaacagccctattaaaaagtgggcaaaggacatgaaaacacttctcaaaagaagacatttatatggccaacaaatatatgaaaaagagctcaacatcactcatcattagagaaatgcaagtcaaaaccacaatgagataccatttcattccagtgagaatggtgattattaaaaagtcagggaacaacagatgctggcgaggatgtggagaaaaaggactgcttttacactgttggtgggaaggcaaattagttcaaccattgtggaaggtagtgtggcaatttctcaaagatctagaagcagaaataccatttgatccagcaatcacattactgggcatatactcaaaggaatataaatcattctgttacaaagataggtgcatacgtatgttcattgcagcactagtcccaatagggaagacatagaatcaacccaaatgcccatcaatgatagactggataaagaaaatgtggtacatatacaccatggattactatgcacccataaaaaggaatgagatcatatcctttgcaggcacatggatggagctgaaagccgttatcctcagcaaactaacacagaaacggaaaaccaaacaccacattttctcatttgtaagtgggagctgaacgatgagaacacatggacacatcaggggacgaacacacactggggcctgtcaggtggggcagggggaggaagagcatcaggaagagtagctaatggatggtgagcttaatacctaggtgatgggtggatattacagcaaaccaccatggcacacatttgcctatgtaacaatcctgcatatcctgtacatgcacccttgaacttaaaataaaagctgagggaaaaaaaaagtagtaagctagaatgataagatggtcagttataaaatcaatatattcttaaagaaaagaaatcttccaaggaccttattttctcctaaatcttccccattaaccaaccactaaattaatctcaagatttgatactaaaaacaataaatgaattttccctggctttttaacagaatttccctggaatacaaatgacatagggaaatttatagaaaagactatgacaagtaaagcatgaaaaaaaaaattaaaacccagagaagagtactttattgtatccatattattaaaatgcatctgatgaaaacataccactcttatcatgtttacaactagcatatgacgtgtttgtcaactaacctgtgaacttcaagagattttatgtttattaatttcttaaatggctaagcatattacaatgctgtaaacactatttgagactcagcaataactgttgaatgagaaagcaaattaatgttaaacagcttcatggttttaaagttactaatattaaaacttttgtatcaattcagttggaaatgaattcagctgatgtttgagtatgtacccagcagtcttaattctacacatacatttaccaatctaataattcagcaactgagaacaaattattgagaatctaatgtgtccaaagtactacaataattaaacaacaaatataacaataaaataaatagacaaggcctattcttttatggagcttaaaatttatcataaaaaaacaatgtcccaggtcactacaaaaaaatatgattaaaatggagctagcgaaatgtattgagaacagaaacaataggaagacttaatacagctttagctgaaatcagatggatgaattgaagttagtcatttgcaactgtagagaaagagtttgtatagcaattgggtaaaatatatataaaggcttggattgggggaagggcttgattaatctcaggaactgaaaaaatataatacaaatggaatatggggataggtctagcaaaccaagggactgacaaaataatgaagaatgaactggagaagaatgttataagacaagatcactggtttggtttttatttcataggcaatgagaatctgctaaagagttttattttaaatatactggcattttgttaagatcattctgactgcaatgtggagattgaattagagatgagaaaccaaatatgaaacttaacttctgctttatccctcatttgtgtcttgcgttagtatcactgtagatattaactatagagaccatatttagaaaaataaatgaaagctctgttaaaatcttcagcatcaaataagaaaatctaaacacaattttaataaaaacagttatttcatatctaggtcgaaaagaagacaagagtaagcaagagagagagaggaaaaagaaaataaattgtactaaatattacacacaagtactttagcctcactgatataaattaaaatttaaagagttaaaataatacacataaatcatgtttatatattttacaggtaacacattattcctaaaacttttctcccataaagctgttgtcaatgcatgaacattcaacaaccatttacataaaatacatatgtaattgtcatgcttcaattattatgttaataaatcctcagtctttctgatgggggaaattagcataagtatctcattacaatgtgggaaattttctactaaacaaaccaaattattttgcaaaggccattgaacagctgtcaaatgaaactgacttttggtcgaaatctgtgggtgtctgattcagactaacaatatacaggttaaatgtatgtaagtgactcatcagagccccaagtctctctactatttaaataaagttttcaggcaagacagggctcatgataattctttccatatcattagcaaaactattgtgcaatgttttaggttaaccaactctgcatactcaaaaggcatgtaaatttcctgatgaataatatatagaaagacacaaaactgtggcactgacttctgatgatttatatgcactccttgaagaggatgattttaataagccatagataaaagatataaactatatgctgatttgctaatttaaaaaaatgatattttgtgattaattttcacattttattcacattgaaaaagctataaacacatcagagatagtaagtaataaatgaaataaaacaaaggacaatgtaatatatgaatctaaaaatatgtaaatttttgtaagtaaaatagaaagatctctataactttgttttataaattaatctgtgatttgataaaggcagttgacatatgtactttgtcatcttagccattttcttctatttgtattcttcctccttacccccttctattcttcctcttcctctttcttttactatgattactgtaataactactatccattattataataatgacagcaatccttcaatgattcacttaatatttactgtaagcctggaactctgctaagctaatgacattagataattttatttaattctcacaataaatttatgaggtaagaattattattttaattttccattgaagtatcagtctaaaataatttaaacagattttccaaggtcacatagctaaatcatacagggttggtcttgatttctaattctacctgattccagagttcatgatcttaactgctttactattttgccttcatctggcaaaatagtttaattaaggccaaaactgaacaaatgaatagacagtgaatgcactcaagagtacgacaaggaaaaaagaaataatattttaaaaataactcatgagttttctgtaatgtttgttcatttaatttttctttcatttgcagtttatcacctcagaaatgaggggaagtattggaacaacaacatcaataaaaaaagttcttatttaggaaaaatatccctctgacaaatcagagaggaattagatgtagaaaggatattcatagctgttgtctggtgcctttttttttttttttttttttttttttagtagagctggggtttcaccatgttgaccaggatgctcttgatctcttgaccttgtgatccacctgcctcatcctcccaaaactgatgcccttttaataaacccagcacttcctatttccttgcatcacagctcaggttttggaatgaaagacagactctctaatagaaaagacataataatttgaaggattccaagaacatcatggctagtgtgccactggtcatcgattatgggaggatgtaatagtcaatgaccgcacacttttcacatggtgccatatccaatattgcagacagactgctataacaggatagccatgactagtggataacaggatagccataactagtggagacccaggaaagaaacttccctatacactgtagtatggtgagaaggaagtgaccagattcccctagccacctggaagtgcttattgacaagtgagaagaagaagcctggatagaactctggatgttgcagttcagatgcattctacacctccagagtgtggcaaatatcaaatttataaaatccaaggaaacacagagagccagtgacaccacagaacacaccagcacaggatgctcaagagcagaccggatgagccacacatggcagacagcttaaagcatgcagcaaaagaccagaactatagagaatcccaatataggcataaattactttgctcctgaagacagataacatcatggaaagagagagagagagaggagagaaggccatttgagagaggacagagaaagctctgacaggaagtagaaactttaaaaataaattggtatttaccctaatacctgaattaatccaaaacggactcttttaaagaggaaacaaagagttatctttaactcactggtatccctcttctctcaggggtccataggtaatacactgcttctgttatttcatgtattttggggagctgcctcttttgtgtcttgcctgacctagacctgaacctaactaccgtcccagttggggctgtcttaagagagtggccgtcttcgtaggaacaaactggattcaggtcagacaagagttacaaggacatctgccaatataaacaagtttcctgtgagaggacagctgtcacagattagacatttaggctaaagaagtagcctgtgaaaggcttattgtaaacatccaaaacaaaattccttagattcttggtcatgtcatggctaccacttatgaccactctctggagagaaaccttgagacaaaactagaaaaaaagctgcagatattctagaaaatttaaaattacttgcagaaaaaaaaaaaaaaaagaaaagcaagtgtatttttgggtagtattgcattaatcttgaccaatctgacaaacaggaaaacacactcccactagcttaatattctaaacactagagtaattcacttaactttaataaatagtgggccattattatttaaaataattatgtgttcctctttaacaagagtaaaacaaaaagtcaattcaatactcaaattaatcaataaaataaaacgtacagtcattttgactcatctacataaatgactaagatcattttttattccgactatttattttcaagtataatattctaaaatgagcatatgcctaaagatataaattaaaaatgccaatcatcccaggaataagacccttactttctccaaattttttttcatctcttcgctgcttattaaagctttcatcagaggaagaaaaaaagattaaactattgcaggtgacattataaaatcaatcaaatgagtgagttacttccacacttcctatttaaaaaaattaaagaaatcagagacttacagataattcatgtgtggagccttctctaattcacacttaggttttatcagtttatatacaatggaatcctgtagataatatctcttgattagtattccaagtctaatggtcaaacagattttacatgtagaaaagagatcaaattaattgagataatacattggataaaattatacttggcattgaaggacagctcaaatgtggtatcacagaaaataagaacatttataccaccagaaacactcatggaggtattggtacaacgagtttgttaaacacgtgttaaatatcatctaaacaaaactaagtaaaatagattaagaaaagattctctaatacattaagaattcatcttagctgatgtattagccctgcctactttcttaaaatctctccctattgttatcacaataagttataaacctattattataaaccatggttaatgatcaatttttaaaataaatgaaagaaaaactgaaagcaaaacaaccactgaatgtgattctccactgctcaggcactgcatctttcaggttcagctgttttccatcctctccattcatctttctgaggtactgggaactacaactgaaataaaggcaaatagcaagaagtctttggcctggtattattccacctcatgacaactggcagaggtcttatagtttatacaccatgattgtgggaatgcatgtggggatgggatgcagtgaggtgctataaaaaatgtatcttcttatgtaaaagaggattatggatactgttattttttgtcttggtgatcagagaaatatagctttctgaatgtacatagaaattcctaattctagtggcagcgtggaacacatgcactaaagatcgttacctaaatcctgaagaaaattcactttgtaatgaatttttggacttactctctatcattgtcaataacaaacctgatatacaaactttgaatgcaaatgtcccaattcacacaaagatcctgaaattaattcttgaactagcagcaggtttgaacagtttacttttacatttcatattgaaccataaaccttgaaagcaaaactgtcccgtaggtgtctagtagccccaagtttgcgataatacgtttatcgcacatcaaatttcattctggaaaaaaaaaatccacaattctgcttctctgaatttctaaggagtaaaattaaaaaaaaaaaacatcataatcaaggataactaaaacataaggaaatgagctactatgaatcaaagtcagtataagcatcgaatgtatttggactacaaaagtttttatatattagaattatttgatacataatatagaataacatgtctgaactagacagcatggttaatttcataaaaaaggtattaatcatgaaattgttttcaaacagacaataaagaatttttaacaggaaaatatatcttttattcttaaaaattgaatgatgaacttttttctcaacagctgattagagaattatgagagaattactggactaaaattagatctgtacggctggcagcggtggctcctgcctgtaatcccagcactttgggaggccaaggcaggtggatcacgaggtcaggagttcaagaccagcctggccaagatgctgaaaccccgtctctactaaaaatacaaaaaaattagccgagcgtggtgacgggcacctgtaatcccagctactcgagaggctgagacagagaattgcttgaacccaggaggcagaagttgcagtgagctgagatcacaccactgcactccagcctgggtgacagagtgggactctgtctcgaaaaataaaaataaaaataaaaaataaaattagatctgtagacaataatcacgtaaaagagagattcaaaaagttaaacatttgaaagaaaaagtacgtaatatgatagctaaaatgaaaagttctaacatatgtctactttaaattccaagaagatgggttacagaatattttggagaaataatacatgcaaaaataataactacaaattttagagttgataaaagagtgaccccatagatacagcaagttcaatatatactaaccaagctaagtaaaacaaaaataattaaatatatgtacattggagtgaaatgccccatcaccagggatacagacaaagttttaaaagcagatggcaaggacagatagaaaatttacaaatcaacgaatggttgacaggatacttctctgaagcaacaacaaaaatatcttaagatggttaaagaaacaggtgtcagctgaggactgggtatacagcagatataaccttataagtatatactagtatatacagcagatataaacttattagtatatactagtacatactaatatctattttatatactagtatataaaatatgccagtatatttatttgctagtatatatatttagcatatatttatatactagtatgtaatttctaatttatatactagtataaaatagaaagcaaatatgagtaaaaacaaaacaaaagaaaaactttgaaaaaacatattactaacatatctttgctaaaccaacttctagcttctcagacaagatgagaaattaccctagaagtaaatcctaaaatggaaacaaacaaaacataagcaaaaagataatgaaacagttaacgtgtagataaatctgaacaaacagcatctgtattaaatgttatgcagataatttctaaattaaggtattaaatagaaattagccttaaaacattggagattattaggttattaaagaggaacagaattatcagaattaagtgttctagtgtccttgtatataacaggagagagatttaaatattgctttgcatttaaaaagttaagtttgcaattaaaaaatttaatagcaaacatggaaagaatagaaataatgttctaaatagcaaaggagaaaatacttagtaagaaaaaaaactgacaaatagaaaaactcatcaaataagcaaatcaggaaggaaaagaaatattttaattgagacaaataggaatttcaaagtataatggtaaaaatcagggcaaatatatcctaataaacagaaatagacaaaaacaaagtgagagcttctagaacttcatttaaaatgatatgttttgtcgcatgaaaggaaagaaggttagcattccccttgacaaacctagaagaggctcttgggcttatcttgggtcttaaatattgtgtagcttaaggaaaaccacttaacctctctgagcctcaattttttcacaactttaggtgtttctaagcagtacttcaagtatcaaataaggtaataacttaaaaataaaaaataaaaagagctcttaaaatataaagaatcactcttatgatatattccctacagaaaaagtattttcctactatagaaatggaaatgcactaatagtttatacattaaaaacatacatatgaattaatagatgtataagcagtacactgtaactaactgcagtttgaggtattcaataacataaaaaaattgtctatggatctttaaataaataaattatatttttacaaatgctatttacatctaaaatataaagataggccaaagacagaggatggcaaagtttttatgtaaacggtctaataataaatatttttggctttatgggccatgtggtttcagcagcaactattcaacttggttgctggagcatgaaagcaaacgtagaccataaacacatgaatgagatggctatgtctcaataatatttcatttaacagcacaggagatgggccaaagttggcctgtaggccatagttcacaacctctatcctaagatatagagagaaattttcacaataatggagggaaaacatataacaagtcaatattgtccaaaagaaagctcaagatagagacaaagggatcaattcttacaataaaattttaaaaccaccaggaatatacatttatatacttgaacatatctaatagactagccttaaacagcatatttcaatatttcaataacttaaaagatacatattagtacacactttaacatctctacaataaggatgaatttcagtatttatggcatttcataattactggtgaccaggcagcaatcatgacaaagatgtcattgttagactgtgtgtaaacttaatccttgtattagtatgttttcacacggctgataaaacaaacctgagattgggcaatttacacaataaagaggtttaagggacttacaattccatttggctaaggaggcctcacatttatggcagaaagtgaaaggcacatctcacatggcagcagagaagaaaaatgagcttgtgcagggaatctttcctttttaaaaccatcagatttcatgagatgtattcactatcatgagaacagcacaggaaagactcagccccatgactgagttacctcccactgggtccctgccacaacgcataggtattcaagatgagatttgggcaggaacacaaccaaaccacatcattctgcccctggcccttccaaatctcatgtcctaacatttcaaaaccaatcatgacttcacaatagtcccccaaagtcttaacccactttagcattaactcaaaagtccacagtccaaagtctcatctgagaaaaggaagtctcttctgcctatgagtttgtaaaatcaaaagcaaagttaattactttctagatacaatgggggtacaggcattgggtaaatacagccattccaaatgggagaaattggccaaaacaaagggactacagatcccatgcaagtctgaaatccagcagggcagtcaaatcttaaagctccacaatgatctcctttgactccaagtctcacatccaggtcatgctgatgcaaaaggtgggtttgcatggtcttgagcagctctgctcctgtggctttgtagggttcagcctccctcccagctgctttcatgggctggtgctgagtgtctgaggcttttccaggcacacggggcaagctgtcagtggatctatgattctagggtctggaggagggtggccctcttctcagagctccactaggcagtgacccagtagggattctgtgtgggggcaccaaccccacatttccttctgcactgccctagcgaaggttctccatgagggccccacccttgcagcaaacttctacctgggcatccaggagttttcatatatactctgaaatccaggtggaggttcgcaaaccctaattctggacttctgtggattcacaggttcaacaccatgtggaaacagccaaggcttggggcttacactctctgaagccatggcctgagctctacattggcccctttcagccacggctggagtggctgggatgcagggcaccaagtcccagggctgcacacagcacaaagacgctgggcccggcccacaaaaccactttctcctcctaggccaccgggcttgtgatggaagggactgctgtgaagacctctgacatgccctggagacattttccccattgtcttggcgattaacattccttcacctccttgttacttatgcaaatttctacagccagcttgaatttctcctcagaaaattggattttcttttctatcacattgtcaggctgcaaattttccaaacttttatgctttgcttcccttataaaactaaatgcctttaacagcacccaagtcacatcttgagtgctttgctgcctagaaatttcttccaccagatactctaattcatctctctccagttcaaagttccacgaatctctagggcaggggcaaaatgccaccagtgtctctgccaaaacataacaggagtcacctttgctccagtttccaacaagttcctcatctccatctgagacgacctcagcctggatttctttgtccatattattatcagcattttggtcaaagccattcaacaagtctctagggatttccaaagtttcccacatttttctgtcttcttctgagccctccgaactgttctaacctctgcctgttacccagttacaaagttgcttccacattttcgggtatcttttccgcagcaccccactctcctggtaccaatttacggtattaatctgttttcacattgctgttaaagacatacccaagactgggcaatttacaaaagaaaaagttttaatggactcacagtttcacgtggcggggaggcctcacaatcatggcagaaggtgaaaggcacatctcacatggctacatggctacagacaggataaaagagcatatgcaggggacctctctttttaaaaccatcagatctcatgagacttattcactatcatgagaacagcacaggaaagatgtgttacaatgattcgaatacctcccaccagttccctcctataagatgtgagaattcaagaagagatttgggtggggacacagccaaaactctatcaatcttttatccttttggcataaatgggcaccttgaaaccccttaaggttccagttcagaagccctctaagaatcatttgaagaagtaacacaagtcacaattgtctgaaaacctccagttgtcacagtaaattgtcattatcccaactggaagaatgagtgccagtggtttgaaatgttccttcagatattaatgttgtactattctaataaatacttcattaccatattccaaaatattatgcaatacttcacagaaggtgaatatgaaatggaaaaatcaacattgatgatgtgaaaaagttcaaagtatttaacaattagttatgcttaatttatttggtttatgttatcatttttatgtatacataagtgtgatatataattattaattgatagcaattatcagttaataattggtaactaacataataactaatagtgttcacttactcaaaatggtacataaaatgatctatattataacaggtgatgtctaaaactggataaaatggtgacctaaaaattgatagaactacagggtgagattgccaaatccaccatcatagtgcatttcaaaatgcctcttgtattgattgatttgtcataagcagcacaaaaacttttaaaggcagaaaatatttgttctgcataattaactggtttaccttaattgacgtatattaacactactaataaaaattttaaaattgttttcaaagaccatttacaaattcagccctaaaatctctcaatatattttaatatttgagcacattttaatcagaaagtaattaaatttaaaagttaaattaattatagttatacattgaatactagtttaaatatctcacttttaaaaactatgatataatttcaaaattttaagatttaaaaagaatgagagaactttacatcaaatttgtagactgcagcaaaacgatattttcaaaaaatatatgtctatacatttttaagaacaaaaagccagataatcgatgtcacatttctctactcatgaattagaaaatgataaaaaaaaactcagaataaatccaaattagaataaaataataataaggatcagagtagaattatataaaataggaaacaatataaagagagaaaaaaactaaattgaagagttattaaattaaaaaaattctggttagattgaaaaatgaaaaaataaggaatttaaaaggaaggtataatatttaaatttcttaaactattttattaactgtataatcaccatagttaataaaattcattaagaatttaatataaatgtaaaattttacatgaacagattcctaggaaatacttaatttacaaaaattgacataagaagacatcctaaaattgacaaaaattgacatgagaagacattctaaaataacctataataatgaaatatattgaatcatttattataagtcatcctacaaataaatcaactctgatgatttgataggtgagttcttacaaacactgaagaatacatcattccagcagatacaaaatcttataaaggagaaagaattataatataaacacccccatctcatttttactcgccccagttcagccttaacaccaaaactcttctgaagtgcaaaaaatggtacataatataaaaaattaacagtttttcatgatattttctgtaactatattaaatgatgtttgtttatattttaaaatattttgtgtaatcaaatattaaaatacaaataaattaagatcaacagcactgataataaagctctaaaatgtctaaactctatattgttctgtatctgtcttaattaaattttctcattagtagcagaaaatttgatacagtttttcaagcagatcaatgatttatagttttgatcaatacattcagaaaaataatatttgagaatataaaaatattttctgcaattataaaatggtaaaaaacatgaactgaaatttctctgtcgctttcatctgaatgttgaaacatgattgatatggcttgaaacagagatttacgacacctgctattccaaaaatcaaagatttaggactaagaatcagcagaatatcagtatgaggaaaggaagaaaatatgtaagataaaaatatcctgtataaatttcgctctcagtctgtcatcagaaattattttgcttatagaataggaaagagaataaaacttgtttataaaatttagtttaaatttaataggtttagatctttatgtcactttttaaaatataataataataataaaagatacaagtgaaacgaaaatctagaaggaagtcagatgtcctgaaaatgactcaccattttagtaatttaaatatagtattttaaaatttattttttacatttacagagagaattgtatgtatttattatgcacaatatgttttgaagtgtatatatacattgcatgatgactaaatctagctaattaacataagcatcaaatcacataattatcacattttttgagagaacactctaatccgctctcgaagcattttccaataatatggtacagtattacctatagttactatgcagtacaatagaactcttgaatgtactcctcttattgttagacaaagacaaatttggtatcctttgaagaacatctccctgtcaaccacaccaccgcagcccctggtgaccaccattccactcttccacgagataacgtctttagattccatctatgagtgtatttgtctttcacttaacagaatgtcctccatgttcatctatgttatcataaatgagagcttagccttatttaagtgcctgaattatattcctttctgtatataaaaatataaaatttaccaacaacaaaaagcctagaacctgatggcttcactgcttaattctatcaatgttttcttattactgattgagttttcttacttgtcattggttcatttagattttctatatctttttaattctgtcttggtaggttgtatgcatcagataatttatctatttcttctaactcatccaatttgttggcctataattatttataatcatctcttatgatcttctgcatttttgtcatatcagttgtaatgttttctgttttatttctggttttattaatatgggtgttctctctttatagctattctgtctaaaatttgttatttttatttatcttttaaaaattaactcagttttattgatattttctattgcttttctgttctctatttcatttatttctgctctcatcttcattattttcttcctctactaactttgagcatagtttgttcttggctttctagttccttaagatgaaatgttatgttgtttaattgaggtcttttttctttgtcaatattgatgtatgttgctgtagacttccctcttataattgctttttctatgttccatatgtttcgtccctccctatttttcttcctctctttccttttggaatgttatcacccactaattatacagacccaaatctattatttcataagaactgtgtaaataagttgttttctaatagcttcaaatacttactcattcttcaattattagcattttccaagttttaaaataatgatttcttttccttaacattacttaaaagtaaaaaaaaaagtgttatttttaaaattataaatacatttttgttggtagtgatgtttccttttgtactcagacttcaataaatttgatgtgctgtaatccattgaaaccattattcttttatgtttgggcaatgggaggttattcaaatgagctctagattgtttttgatataatctgagcactcttatataggtagtttcttagctctatggtggaataaaaagttccaaatttacctcttatgttttctatcccagccatggaatcaagtttctcatgtaaatcttgtttcttttaatgcaaactgaaatgtataaaccatgaaaatattacccccatatatacattatatatatatataggtaggtagatagatagatcattttgtttatgcatatatacctactacttcaaaataataatatacatattgtggcttataattattgagtccagtgcagttatttttatacttagggtattattaagttgttttgttttaaacacatgtataattatcttttctgcatcattttggaatcaactcaaattttagttagattcatttcatgttgctttctgggttcagggtttgctttcttccatttttatcattttttaaataattatttgaaatatttttatatttctgatgtcaaatttgcaaaaggaaatatactaagaaatgtctattttctatactttttttccagtcttttccaattctatctgtaacattttactaatctgcttcgttacattttacatgtaattcaagcatacatatatatatgtgtgtgtgtatatatatatatggcatacatatttgcatgtatacataaatagtatatgtataatttataatatatacacacacagatttgtttttacacctaggtcttttatcttagtaacatatcttggagaacaattcatataagtacacagaatcaaattaagcctactcttatttcaggccagtttacttcagattctatattatatctattattcgctgcatttgaccttctgtgccctgtgctattctttcctggctaggcttcatacttatcactttctctaaaattatttttaatatctcatctttatattatttttaatattcatcttttccgttttttattaaatgaaggtattaagttcattcattcattcatttttggctttcttttagttagtctttatttctgaaatgttggttttgaaattttatttctaattcttttatgagttctgtctagtctcttcacagtttccttttcctcaaatatctcatttctgaattcatctaagttggattcttgctattctttcatagcctccagtattctctacttttagttttttatttctttttctttttgaaatattagataagagtttttaaactatgtgtggataagtctttctggggttcctccagaaataatctctgtaggaatgttattacctttactctacacttaagaggtagcttttttatgtgatttaactgcaatattttctattgcttatgttaaattgggatgaattttcccataattcttggagaaaaagatctgccaggttactattcatagctccaccgttctgagctaatatctactatgagccacattatttttttctaacacgagtggctttgagctttttcacatcttttgagtattctcttctccaatttttgttggaaattctcctttctttccgcctagagtttctgtcctattacctgggattccactagccaaaatctagctttagcctaataaagattacaggtagttaattccaagaattcacaaggtgtgcaaccctccaatacaataaaacattatagaagtacatttgctcttacttacaagtttatgccttaaaaggcttctcttaatttcagctgttcatctcagattgtcctgttgaccattcttgttagtaattttggcagttttggtgttctcaggttttcggggtttttttcctttgtcttcctttgtcttcctatttgtttttttgttttgttttgttttttacccttcctacacactttctgagagcatacagtgttgttgctattggtagtttgtcatactttaagtttcacagtgacactttgtcacttagttttgtttcaaatgtttttggtacatttcttgatttagttgctttgttagattttgtgggtggatttgggaatattgaataaccacagtgctgctgacatcttacctgatatatcttgaatatactgatttaaataaagcttcaataatttccctccttccagatttcactaatgtgccaaacacctttatttattttcaagattcttataagatatattaggtataaaacatatattaagaatcttttcaatattcttttcaagatatattaggaaggaatattagtgcaatgaacttggggtatgatgaggtgaagaaaatgattgcgagttttcttgcctggtagtttatacaagtgttggttatttccaggtagtactggaccataaagatgagtataagggggggtagaataacagtcagcagtcatttggataacagttttgaattcccatgatgggcaagacatgttacaggcagacttatttctagactaagtgcaacaagaaagaaagctttgaagaggatacaaagcatcatcctctaccagtctgctgaagaaacaagttataggtaaacagaacatctttttcaaagatgtatatatattttaaacagggttgattttgcaagtcaaaatgatagtatctaaaatgttggaatttcatgaaatctgaaaatgataataatcatcatcacaacttgatatacaccaggaattgtgctatatgttcttttgtactttatgttgttgaaactttgaaatgatctcataagtaagtattatcatcccaattttgtgggtgataaaggttaaatgacgcaccccaggtctcatagtttgaaagtggtagagtactttttattattatttttattattattattttatttgagagggagtcttgctctgttgcccaggctggagtgcagtggcacaatttcggctcactgcaacctccacctcctaggttcaagcaattctccagcctcagcctcccaaatagctgggactacaggtacctgccaccatgtccggctaatttttatatttttagtagagagggggtttcagcatcttggccaggctggtcttgaactcctgaaattgtgatccacctgcctcagcctcccaaagtgctgggattacaggtgtgagccaccatgcccggcctagagtactttttgaataccaacctcttaactggacataacactgtatatttaaccataggaaaccattatgacaaaaaggtaaataaataaacttgtaactcagaagacaaaactgtttaacaagtcaaataaagcataaactataaataacagtaagcaaagctttaaaattttgatttaaaaccacaaggttgtgtcaataatcctaggtcgtggcttaaaaaaggttatgatacaattgagaaaatgggtttctgttatggaaaagcatgtcaggtgattctggaggaggcactgagataaggtaacttaaaaaatagtatacaattaattttgctgtgatccagctttatcgtctgaatatatgatttttaataataattttcaataattatttgattatacaaaatctactctataactcttcatttatctttcttggcctataaacttcgtcttttaaaaaaaattctacaaggtttgtctgctcctaaattcatttctttacatgtaagtattctaggctagctccacttaatggcctattagcataaaatttcacttcttgtacttaatttaagagatatactatctgctcttgtctaaatctttataaatactagctaaaataattagttttctgttaaaaatgattttgtaacattccatgaagtcttatctattgtcttgctctcagtgcttacctctaatacctgatagcttattgtaaaatcattcacttggtccccattttgaaaaaaagaatgaggaattcaagttctaattataactgtacaaatggaaacttgatgtgagataaacgaattatctcaaagcctgagactctttcttgacaatcacaagagtgaattatttgacctacaaatactccttttctgctgtctaaccttattggcatctttggcaggggtttgttctattttctttgtgctttctttaccattaaaaaataggcagtatttactttacttttatctctaaaagtttatttgatcatgggctatttttaactcaactcagtcaatatccattttgaaagagtgatgcggccaggcacggtggctcatgcctttaatcccagcactttgggaggtcgaggcaggtggatcacctgagggcaggagtttgagaccagcctggccaacatggagaaacctccgtctctactaaaaatgcaaaagttaaccaggcatggtggtacgtgcctgtagtcccagctactcgggaggctgaggcaggagaatggcttgaacctgggagtcagaggttgcagtgagcagagatcgcaccatggcactccagcctgggcaacgagagcgaaactccaactcaacaacaacaacaaaaaaaaaaaaaaaaaagagagagagagagagagcaatgcaataaatggtagaggctaccaaaacttatgaattaaaaggagaagtggaaagagaaaatggttgttaagagcataatatatacatggcattgtgtgaggtactcagagatttctagatttctatactcagaaaaaccctgcaagtggcaataattattatttatcacttgtatatgtgtgcacatgtgtgtgtaggtggttgcgtgggtgggtgtgacactttaagaagtaatctcttttcaagtttttctgactaaaaaatctatgattttgcttctatctatattgtatagtgttgtttgaatgcacaatctggaagattaaaaacctatttctgatgcctccatgtggctgtttcttcaagacagagtcccaaattgatatatccatgaaagaggcaggagaaggatttgaggatctcgtggttctcatgatctttgtagttacagatcctgctctttacaggtgagataattgtcgaaagaggaagggatacacacagctgtctttgctgttgagtggagctagcacacttttcaatttgcatattttcaaactcacacaaactctaggagatattttttcttccattttagaaaagatataacagcagatcagggaatttaagtaacttgctgtggtagttttgtactgtttgaaccttgccaggtgaaactacattttccagtattccttccttgtgtagttctagttcaggcttggctaccagaagagatgaatttcagatttagaagatgggactgaagcagcagcccccactctctgaaattcagcatagggttcaggtgctgccacagctgaaaacacgttttccctgctctgctggctcactttgtaagcatagggcaagctcacggcaactccagctctgcattcaagtgtctttcttcatgctaagtcctaggacaggcatttgtgcaggttcaggatgaaggtcaacagtttattctgtaggtcacagaggttagagacagtgaaagatagaggcagggttcactttgtctttgtgagtcttggtttctccccatgagtgccggttgtctttgctcttcccacttcaaattcagtttttctaattgctagcactgctgacctacactgactgcagaactgctaaagacacagaggtaacaacttttcatagacatcggcattggcactcataattatgtaggatcaaatctcactaataaatttctaattccacatcactcatagtagttctacttcttgatagatcctaaattatgtacttgctagtttccatacagctgacacatgggtaagattaaaactttaatctggttgtataatacatgcactttccccttcaccagagtgaattttaagagagggaaaagaaagtgcaggagactctaattcccctgaccattaataataatgtggctcgagagctttctccagattgaatccttccttttactcttttatgtgcagacgcatcaaagggaatgtattattactgctgaaatctgtgctgaaccgccaaatattcaacactctaaacccctctctattggatactactcattaacaaagtaaaaaacaattatcctgggcatgacagctctttattatttttcatgcatcacagtaagcctttttcatataaaattatatagtcactgaaaatattcatctttcctaaatgtactttttgcagctgtaatcgatctgcatctagatgattttggtctttcaaatggttgagaaacttctttactgggcagttaatcccatttatgttctgagtgaccaatttgtgcgttatattacctgccataatatctccattgtacataatatatatttgatttaacagctgtaatcttaccaaactgctgtttttcagtcaattgtcttcatggactcagattttcagaggaaatcttcctggaacaacagccaataattatctaagggtactacatctactatagatgtcagctcatcaataccattttcatattatcaatatttttgtatcttacataaaatctttgctttattcatgtggaatgttaacaaggactagttccccagctccaatatttaaccccaaacattgttcttttaatgatttaatgattaacaatttattttagaaattgtttcatgggtattattatttttagaaagacaaaatttttgccataaagacattatttcccttcagtactgaaaggttattaagttgaagtgtccttcttgcatgcaataattaacaaagtgatttggttcaaagattctacatgtgcactaaaatacattttgatggttaatattgagtgtcgacttgattggattgaaagatgcaaagtattgatactgggtgtgcctgtgagggtgttgccaaaggagattaacatttgagtcagtgggctgtgcccacccttaatctgtgggcacaatctaatcagctgccagcgaatataaaagcaggcagaaaaatgtgaaaaggcgagactggcccagcctcccaacctacatctttctcccgtgctggatgctggatgcttcctgccctcaaacatcggagtcgaaattctccagttttgaaacctgaactggctctccttgctcctcaagcttgaggacagactattatgggatcttgtgatcatataagttaatagttaataaactcatatatatatataatataatatatatatatatctcctatcggttctgtccctgtagggaaccctgactaatacgtacatttctagtattaaagatcttcagtccatgattttattaagagcagacattgactaattcccatgtgttaattaaaagcaatttaatttactttatttcataactttattcaaatcagatcacatgtataaagttctcactttttgttgaatgaaattatatgtaaggattgacttttgtagctaatatataaaattactccaatgaagcccaatttgcactttatctacctaccataattgttgagagataaagtcaccagaaaaaggtaattaaaggacagttcgaatcttgaacttattttgaaatgtcttctgagtaccaaggtcccttgaccaaaattaaaaatcaaatgcaaaaatctgggaaatatacactttatttatttattgagacgaagtctggctctgtctcccaggatggaggacagtggcatgatcttggcttactgcaaattctgcctcctgggttcaagcaattctcctgcctaagccttccgagtagttgtgactacaggcgtatgccaccaggctcaactaatttttgtatttttagtagagatggagtttcaccatgttggtaaggctgatcttgaactcctgacctgaagtgatctgctgcctcagaaatatgcactttacatacaactttgggagtaatattttaagtttatgctttacaattttgaaatgcataacgtgtagtaagttaaaggtttactcttcacattttgcttttgtttcagtgaaaactatgatatatgttgcagaaatttcttattgtcttttgatgtctttttaaaattttttactataggagtaatatctttagcttgacacatgcccacacagcataaaaactacactttaaagcctctgtctcagattactatgtccatgtgactacatcttggtcaatagagtcttctgtgacatcttttttgaacctttcctaagattcatttggccagttccttgtccctcttctatttcattgttctgttgtctggaatatggatgctgccacatatgaggatgataatttatctaatagatagattatgtgactatagccattaattaactataagaccaagtctctaggatattaactgaaatggaggcaaatatctagcttgatagctatatataagcagtgaattatttatatagttgaaaggaaggggatgttccctccttaaagtagcttaaaccaaagtcagcatatatttaatattctaaaaaaggtttttagtttgatacatacaaaaatgtaagacacaaagtagatattcaatcgtaataatagtatgtattatatacactataaggcacagttttcaagatgtttagttattcatacatttaatccttataaaatagtttggatttgaaagtaactttcctcctctgataagctcctaagtcagaaaataaattaagtttttaaatctctcctcttggtcgtgatggaatttttaggccccttcctgcaggaaggcaacttgggagaataaaatagcagataattgtcctgactcccactattactttcataaaacatgtggacttaacagaagcctatgtaagaagtttccgctcagaatttaaaactgaaaggcatacaaagcctctttctcaccaaattccttttaaacaatctctaggacttgaatttgaggtagaaggtatgaaacacttacgagtcattaccgattttctaaattatttctggtcatctcttccatttcctgagccctcaatgatggcctcataattattctcgttattattttttcattctttctgctgtgtagggatttccctaaacttctactctttctgattccaggcctatgacttatcctaaatcaccattctcaatcagagcagtatcatctctctagggggcattcgataatgtgagaaggcttttgagttgtcatagaaactggtacaaaatactggtatctttatgcagtgtccaagaatataattcattgtttagtaataagattgttcccacccaaaaagactgcctttcccaaaatgctagcagtgcacatattaaaatactcaggtcaaaatgatgaagagggtgtagggatggaaaccagcttaatatgactgaatatgcattcatcattataaagtgctcaacaacattatactactaatgaatcaatgctactttcctgtttaaaatatcccacgggctcttcataacccaggctctaacatctgctcaccctcaattagcagagtgtctcacttgctttttatacttggcatcctaagctcacaatacctcaaatatgtcaagctcttccaaggactgacctatttgggcactatttttttttctcaacttagactatttattcactttaacattatattaaacttgtaagggcttacataggtctaagtatcaaatcatctgtgaaaaatactttggcctggtcagggtgactttgcgatttcttcctctgaatacgagaggattgactatattatcactgggtctctttacattgattataagtattggtttacattagaaattcttcctttagagatttgtgaattctttaaagacagttggtttaatctatgtatccttaatgtttaacaaataatataacctgtaatagatttttcaagaaatacttgtcccaaaagtaaatttaaaaataatgagaactttttgtgtagataatatggttcttgctcttactcttcatgttaagtacaacgataagtcctggaaacagtgcaagaggcagccaaataagaacttgagaaggtagaaagagggagattaactggcttgaaaccccaggaccagaagaccatcacggcagctgggtgtcttacattctgccactcaacagaacaaagttatccataccttgcatttgccaatttccaaccaaacaatggaacacagcccacagaagctgattcctgcttcagactagcagaaattcttctaacaatacaaagcggtttggcatcaatgtcaagaaggataaacagatagttccacaaacaaagacaaacaaatagaaaacaaataatacagtgttagacttaagtactataatatcaataattacctttaatgtaaatacatcaatcaacgacagtctgacagatttagtaaaaaaaaaaaaaacatgtgacccagctatatgctatttgcaacaaactcactttgtactcaataacataaagatgttaagtaaaagtatgaaaaatatataccatgaaaagattaaccaataaatagaagaattagttatatttatgtctggagaagtagacattagagtcaagaaaattactattaacagagaaattcataatgaagaaaggatcaatccatcagaaagacataacaatcttaagtgtggattcattaaacaacacggtctgaaaatacatgaagcaaaactttacagtgctgaaaggagaaatagaaaaacccacaattataattgagggctttaatacccctctctcggcaactgatagatgcactaaatggaaaaaatggcaaagagacagaagatcagagcaacacaatcaatcaacagggtctaattggcacatgtagagcacttcaccccaaaaagcaacagataagttttttcaagttcctgcagaacattcacgaagagactatattctgggttataatacaaatctcaacaaatctgttttaattgaaatcattcagagtttgtcctccaggcccagtgacatcaaccaaaaattcattaaataaatataaatagtgatatctttaaacatgtgtaaagtaaatattacactttttttttttttttttttttttggagtcgggagttttgctcttgatgcccaggctggagtgcagtggcacgatcttggctcactgcaatctccacctcccgggttcaagcgattctcctgcctcagcctcttgagtagctgggattataggcatgcaccacatcaccacgcccagctaattttgtgtatttttagtgaagacagggtttcatcatgttggcccggctggtcttgaactcctgatctcaggtgatccatccgcctcagcctcccaaagtgcagggattaagggcatgagccaccgtgcctggctgtaaatattatacttctaaataagctatgaatccaagagaaagtctcaagaaaaacccctagaactaaagaaaaataaaaatatactgtatcaatatatacaatatgggtaaagtagggctgagaggaaaatggtggcactacatgaatacagtacaaccaggaaaggtcttaaatctaagtttctatctcaaggacctagaaaaggaagaacaaataaaactcaaagaaggtagaaagatcagggtaggaaaaaataaaattgtgaatataaaaatagagaaaatcaatgaaataaaaagctggccttcagaaaaattagtcacctatatagtgtacatcgtaactattaagtaatttctcatttcttactccccttttacccttccacccttatgagtctctagtgtctattattcttcactctatatccatatgtacatgtaatttagctcccacttataagtctgaacatgcaatatttgactttctgcttctgagttattttacttaaggtatggtctccagttcaattcatgttgctgtaaaacacatgaattcattcttttttgggtaaatagtattccatttcataaagaaagtgtggtatatacacttatcttttggtatatatcacatttatcttttcattttttttacttttttaaaattatactttaagttctgggttacatgtgcagaatgtgaagttttgttccataggtatacatgtgcgctggtggtttgctgtacccattaaaccgtcacctacgttaggtatttctcctaatgttatccctcccttagcccccccatcccctgacagggcccagcatgtgatgttcccctccctttgtccatgtgttctcattgttcaactcccgcttatgagtgagaacgtgatatgccacatttatatatgtgtatatgtatatatatgtgtatatgtatatatctcatttgtgtatatatgcacacattccatttcatatagacccatacattccattgatgaatacttaagttaatttcatgtctttgctattgtgaatcatgctgtgataaacatatgagtgtaggcatctttttgagttttaatgtaatcatttattttcctttgagtaaataccaactggtagaattgctagattgaatggtagttttatttttagttctttgagaaacctccgtactgttttcaataagggttgtactaatttacattcccatcaacagtatgtaaacattcactttttaataatagccattctaactgaagtaagatggtatctcattgtggtattaatttgcatttctctgatgatattgagcgttttttcatatgcttgttgtccagaaatggactcacaaaagtatgcctaaattatttttggcaaaagtataaaagacatcaatagaggaagtaataggcttctaaacaaatagtgctgaaacaattaaacatctatgggcaataaataaataaataacattggcctaaacctcatacattatacaaacactaactcaaaatggagtgcatacttaaatgtaaaactgtaatatgtttaaaaaactttaggagaaaatctttcagttctatgtctgtataaagaattcttagatttaatagtagaatagtgacccatagtagaaaattttgataaatcaaacattaccaaaacaggtaatattttctgtgcacaaaaaaaaaaaacaaaacctcaaaaacaaataaaaaactgttagctgaataaaaagacaagctacagacctggagaaaagcatttgaaaatcataatgaaggaatgtatacaaagaacctccaaatctgagtattaataaaacaatcacttaaaaatgagcaaaaaaccactaacatatatttcactgatgagaatatatcaattatatgtgtgtgaaaagatgttcaacataattaatcataaggaaaattcaaattaagaccataatgtgtgtatgtgtgcgcatgtggaccaagtttggcaccattttattacctgtgtaggtttatgtatccaccgctgcagtcctgatgaatgactttcaaagccacgaggatactttgttttgtttcttataatcacaactgcctacttcatgctctacccactactctcacccccttaattacttaaatcactaatttgtcctccatttctaaaatttttcatttcataaatgcttaatccatggaaccatctaatgtaagatcttaatgtcatgtaagaccacaatgatacgtcaatacacacctatatgaatgaataaagtaaaaaattgtgacaataccaaatgctagtgattatgtggagaaactgaattattcctggcagggatttaaaatggcactgctactctggaaaaagttttggtagcttcttataaaactatacatgtaattgttataaacctcaacgtttgaactcaggtgtttaagagaaagaaagatgtattctcacacagaaacctgtatgtgagtgtgtacagcagcttaattcataattttcattggaaatagctcaattgtcttaacaagtgaatggtttcacaaacgaaagcatatacatctggcagaacaccaatcagcagtggaaaggattatcctttgatatacacaatgtggatgtatcttctgtgaattgtgctgaatgacaaaaatcaaatctaaaaggacttacattacaagattattccattgataaagcttttatgaaacgacaaattttagaaatggatgacagtttagcactttaaataattaaggctgtgagagtagtgaggagagcttgaagaaggtaggtgtggttataacaagaaacacaagtgatccttgtggctttgaaactcttccatcttgactgcagtggtggatacattaacctacacaggtagtaaaatgatgtcataattagtgtacatgcatgcatatatatacatatatacatatatacacatatatacatatatacacatatatacatatatacatatatacatatacctatatacgtatatacatatatacatatacctatatacgtatatacatatatacatacatatacatgtacatatacacatacatatacatgtacatatacacatatatacatgtacatatacacatatatacatgtatatatacacacacatatatacatatatgcgtgcatgtgcgtaggcaagcagaaatctggaaaggaccgcacaggaccagtagattctattcatgtcaatatctatatttgggttgtcatattacatcatagtttttcaaaatattgctattggggaagccaagacaaagtatacacagaacatctctgtattctttcttacaactttatatgaatctataattaccgcaattattttaattaaagagtaaagaagatttgttgattgttgattatattagcctcacctccctctttgtttctcctgttcatcttatatctgcttatcagtgtctacaaaggtttcactgcagcagcagcagcagcagcagcagcggatttttttaaaaatagcaaaaatcataataatattttaagatactggatataaaagtgaactttgtgttagataataacaacagcttaagaaaaggctcagtttcaggagaaaaatatgccaaggagaaatggataaaattgagattagaattaaacatgacaaggtggaaccacagacaacaaaaacaaagggaaagcaagatatatatatatacacacaaacttatacatgtactactatatatatataatatacacatgaaatgaatataatcacatatttaaatatcattgtgtatagtttccaaaataaacaatttatttatttttgaaagtacatgtatgtatgtttcattatcaaagaaaataaatgataaatgtagcaggatttcactgtatagttttccattactttagaaattatacagtgtaaaaatcaactaatcatcagagtatgaggtcaaacagtcatagagattatgtgagaggaatctggagacacttctcaaagatttggaaataagttaaataagatttatcttattagaggcaaattacaatcactgaatgtagaggcagaaaaaatattaaaaacttcagtgcttcgcaaactgtttcatcaaagcaacctcagttcaagagaaggattggtcctcaagatctggacaaaaagagtttgatgcatgtaacatatttttggagtctcaggttttagaaatgtgtttgaaatttgcattttatcctatgatgtatttatgtaaacatagtaatgttatatatccttctgctccatcatgtaaaatttttgactcagggacacaaatagtttattataaggcttctaccccagtttgggaagcagggctttgcgaaggcaaatggctcttacttcagaggaggtttgatctaatattttaacattcaagaaacagtatagataaattgtagcagtgagtccttccaagcatgtccagagcagtcagtagcttgagtcatgatttaaaatattatcatcctgttggccagaccatcctagtacggaaaataatgaattagatagatttcttcaaccaaattatttaacttattctccttattatgactcactgccagccaagcaagtgtcaaattttaatttttttccacaaacacataactacaaaagtgaaagagctagctaaagtaacgcatataaatgcatatacgcatataaagttatgtatataaaataagaaaaatagcgttctgtgcatatctctctgtatgttttgcttatagtgcttaactcatgagaatttgattcattctctagaaacaaacaaaaaaaatccgccttttcttttcacaaatctgtcaattctagaccattaatccctctgtcatagtactacacagggaagcctccttggtagtcagctgcacttggaaactccacaggctttgttactcttcaaatcaagcttctacaaagccagaggaagtgtttctggttttataatctgaatttttcaagctttaattttatggtagataggagaagaaaacatattttgaagggagagatatggaagttgcctaaaagttttcattagaacagaatctgagagacagagagagagaagagagagagagagagagagagagagagagagagagagagagagagagagaaatgatgggtatgtaggagaacaaaaaaaaccaacattaggtaaagaaatctaagaagaaaatcagaaaaacacaaacattcaccaattagagagctagatgatgatttgtcaatacaacaaaatacgattgtaatctcatctataagtaattatacatacagagacgcaagatagtatatgtgtaaactgtaagtcaatttatgggctgatctcatttcacttcataaacatgcacacttatctgagtatatatattttaataacatgcgttacttcattacttatatcattatacaaaacaaatacaaaacgggagaccttctagataaataatttttttttttttttttgagacggagtctctctgtcgcccaggctggagtgcagtggtgcgatctcggctcaccgcaagctccgcctcccgggttcacgccattttcctgcctcagcctacctaatagtagctgcgactgcaggcgccttccaccatgcccggctaatcttttgtatttttttaagtagagacggggtttcactgtgttagccaggatggtctcgatctcctgacctcgtgatccgcccgcctcggactcccagcatgagaaaattgttttttttgtttgtttgtttttatttcttaaacagtatatccataattgtaaaactaaacttatttaatttttttcagcatatatttactgctcttcaagccctggactaggggctagggaatcgatagaaaacagaaatagatatcattgcagcaagtagtatatactgaatggtttattcatgaagagttcttaaaatgatctgtgccttgaaatgatcaccccaaatgcagtatggagaagagttttcagtgatgcaagaatggatgtggacagaccattagagagaccactggaatgcttcatgtgaaagataatggttacttgtacagggatagtggtagaatcaggacacagtcaggaactgaggtagcattaatgatattcggtgctgaattgctggtaagattagaagggaccctctagcatgactttgagttttttgttccttgaataattgtgaaaatattcactaacttgtgaaatactgagagaaaacccaacttgaagagtaaaaaatatagttgtagacagcaatactgattaggcagtattttaagaaatattatttgaatatcaagtaagcagatacttgaatctagagtttacaggggtaagtaggtctgttatcaacatgtagataatcattaaactacaaataaggatgaagttgccaaagggtagaacatgaactgaaaatagaagataacaacagctgattattagagacctccagcatttattagctgaacattgtagataagcacataaatgatattagtgaaggaaagccaaatatatgataaaaagctacctagttaatgttttgcttttaactctatggttaaactattttatatagattttttttgtgtgctgtagaaaccatcttgaaagaatttagtggcctaaaattacacttatttttttaatcatagttctatgaattgattgaggctagctaggaggtatttgcctggcacctctcatgtgggttgagtcagatggcagctggggctgaagacacccaagggcttgactgctcactaacttggctgacagttaaatttggctgttttctcaaagctgttaaatctttcagtcattatactacacttggagtgaagaaaagaatatcacaagagtgagcattctgtgaaagtgagcagaaacttctagtaatcataatgcctggggatgaaagaggcgtagtgttaagcctgccatattctattgttcaaagatgacacaggccagtccagattcaagagggtagaaaaagaaaaataaactctgcttcttggtagtgtagtgacagattttgtagctgtctttaaccaaacacagataaaataaagagagtgtttcaaagatgaggttatgatgctcttaaattaaaatgagaagtcccaagttaaaacagtaacaaataatggctactggatcttcttaggctcacctcagtctatttttcacgtatttatttctttcgttgaaccaattatatacagcatcttatctcatttaaaacaaagcagaaattaaaaggagacaaagaaaaaaatagaagtactatactcactctctttttattacatttttgacatcatgcagctcaggtccatctggaaccttttccataatgaacaaggggagcaataatatcataccattcaaattaaactttctttctttttttaatgtaaagcaaaataatttctatttgaatatacaattgcaaaacaaagttgaaattctgccaaaaaagacctttagaagcacattctaataactaaatcagagaatgatgtaaatgcttatcttaaatgtgttttctcaaaattagaacgccaagaagcaaagatatatttactgaatgaaatttcagatcagaacgtcactccttaatcaaatattgtatgcaaataaaatacaagattactagaaatactgcacagcttagttcattttaaataacttcttttttaaagataagtgtgtgtttctactcatccataaattgttttaataactaaaataaaattaatttatatatgaaatagagctaaaccactaaggtgtaagagcttcatataatgcaatcaatcctgcttcatagagtataagaaataccaatagatataggagatcgagaccatcctggctaacacggtgaaaccccgtctctactaaaaatacaaaaaaattaggcgggcgtggtggtgggagcctgtagtcccagctactcaggaggctgaggcaggagaatggggtgaacccgggaggcagagcttgcagtgagccgagattgcaccactgcattccagcctgggcaacagagcaagactccgtctcaaaaaaaaaaaaagaaataccagtagatgaaagggagacacagtctggaacactgtcacaaaaagtggcaaaattcatgaaaacatttaaaattgtcaaaaatatataagaggaaaacaaacagtattggacttttaagcctagaaacttgcagatgaatttgtagttgggataaaaggcaggcagtggtgtgggaatgataaagcacaagactggaacgacagtatgcacctatgctaagacaagaactctgaaaaatgataggtgtgaattgctatgcaaggatttcagaccataataataaataattcatttctgaacttttgaaacatgtggagggaaatcaataaacaagaattccttgagatctgaatgtggaaaataaagctttaattctatttggaatgactcaatttttacgcataacctaatgcatttgtctttctcttacatatatacatgtatcacactcatcaagtgcagataccaatgtgaaacacaacagccacgtaaacactaggcagtcattggatttaacttcacataccccaaagcagttgattgacacatttttaggtctttgggtgtttttgtccctgcctcttttaaaataattgcaaataggcagtgcactgtcatcatatatagtaatctagaaagtgacaagtattcccaggtaacagctgtcagacaagtaaaaaatatgaacaagtaaaaaaaatgcttcaatggccagacaaaattaaaaggttttattttaatgtatttaatctacacactagtaatatagataataaaatagtatatatgataatataaaatataaaatgcaatttatgtaaatctcacagtgtctcctgcctatttaaatatatgcctatatagtttgagatatttgatattagataaaatatgaagttacattgctttagttctagtgacccattaatacatagccaagcaaaatcttatcttgccttggtggatcagaggtgaatatttcctaaaacaattttttaaattgaggcctatatttcatacagcaaaattcaacaattttatgagtgtagtttgatgaatttccacatatgctactcaaatcattatatacagtatttcagaaaccctggttccctatttcaaatgtttcaaataaccctggagccattattctgacttctgtcactgtagtttattctgcctatttttgaacttcacaaaatggaatcaacacatatgttcttctttgcgttaagcttgttattgttaaacaaaatgtctgtgagctatatcatattgttatgtgtatcggtagtccattctttattattgtgtcactttccattgagttaatgtgttgctcattatttttcattttcccactgatagatatttgggctgttgctagtttttaatggacagtttatgaaagaaaatatatggatgacacataagcacaaaaaatatgtcaacaacatcatttattagaaaaatgtaatttaaataacataacgataccacatacatctgttagaatggctaaaatgaaatgactacaccaaatatgagcaaggatgtagagcaattgaaactcagatgaactgctgctgaaaatggaaattggtaaaataactttgaaaaacattttagaagattcttaaaacttaaatatacatctactatatgattcagccattccattcttaagtagataaatgaaagcagatgtccatgcagacttttatatgaatgaaaataacaatttgtgatagccaaaaatttgaaacaaactaaattccaatcaataggtggttggaaaaacaaactgttgtgtatgcatacagtggcatattatgcagcaatgaaaagtgatggactattaatacactcacaatattgattaatgtccaaataattatgctgactgaaagaagctggaacaaaatttgtgcatactgcataattccatttatataacatttaaggaaattcaatctatacatattgtatcataaaataacagtcattggtgtatgaggagcagagaggagaggaagagaggaaaaaaagcctgtggatatcttaatttccttgaatttgttgatgatttcacaggtgtgtgcattgtcaaaatatatgaagccatacacatttatgtgtgtgtggtttattgtgttaattacttcaaaatactattaaaataaaaagtttcatttacatcaataatgtggaagatttccagttactctacatcccttccagcatttgatattgttgagttttacattttatgtactctcattcaggctgtattttaatctccttgcaaaacaatgttatttagcatgcattcctatgctattgtcatatgtttattctttttaactacccatttactatgcccaccagctaaagatagccaggagcacatctgtcattcatcatacttgagttttttacttgctgtagtaaggggccaaacatcatgggaaatcatgaggcttctcaataaaagagtgtgaggagagtttcaccacagggcttggacgagtttgtgtttaagaaaatagggtttgccctggattaggtgttatcagaaagcaaggccaacttaactgtctggtctgctgaaaatttttatgcaggacatgagaacagtggagtgtggctaaacctttaattggtaaaatatcatcaggcgttcatagcagcttacggaggagagtactttttagttttcgtggtttgccttgctttattgcttctctctgtgcttagatatgattatggagaggcttgtttttgttccacttcattgctgtcatagagtgaactcatgtgatattatgttaggtgcagttgtttatgtttcacaggagaaacttagctaatagtgctgagatccccaccaatggagagctgtcaacttaccatggctgcttcattcttagtatgtattttgccaattttaaattggagtgtttctcttttagttaatgatttgtaggcagtctttttaaattccacatataataaattagtgcttgataaacctatacctatctatatctatctaatctatatccctctaatctatctgtttatctagagagatttctcccttttctcagcatgttttacctgagaacagatattcttaatgaaatctaatgtattaattatttattttttagttatagttctttttatatcctttgagcttttggtttttgcctattcaaaggtcactatgaaaatttctatattttattctattgttttattttctcacttatagatatcatcctcatataattcattttgcccgtaagtgagataggagtcaaagattttctttcgtttgctaaaacacttaatgggcatcaacctcatttgaggcaattacatagataatgatgaacaaaacataatttatactcaatttagatagactgtggttgttccacagtgcctataagtgaaatgtctgcatttgaaacaagccctctctgggtgaaacatcatacagcacactatttataaaactaacttttatgatgctcagtaaatatggagtaggtttatatgagaatatcttatctctgctgctagtgtttttgaaaataagttagactatcaccttatagaaagcttagaaagtagatttgttttgttagacatgtggcataattctttaccttctcaaaagtgaggaaaatttgagcttttatagaagtgttaaagttcaggaattttctctctgtgttttgaaacagaaattgtgattgatacacacatatatatatatatatatatatatatatatatatatatatatacacacacacacacacacacaaagtaatattcatccacacaaagaaagtcttgccatttgcaacaacagggatgatccttatgcttgatgaattaagtcagacaaagaaggacaaatgccatgtgacctcatttatgtgtggcatctaaaaatgttgagctcagaagcagagagtaaaatggtggttatcagaggctgtgaggtgggggaaatgaggagatgttggtcaaagggtaaacactttcatttgtaagatgaataagttctggaaatctaatatgcagcatagtgactataattaattaaaatgtgttaagactgtggatcttaaatgttcttaaaatacacacacaaaagattactacgtgaggtgatggataaacctattcatcaaagccacctataaattagctggttcatggtattcatttcacaaggtagtcatatatatgcctgtgtgtacatgtatatatagaaaactttgctttgcacatggtacatctttaattgtcaattcctaaacaaaactggactaaaagtcaaggaacaaatttttcctgcaatgtatctatgcaagatgcatttttaaaatggaaaagataataaaatgattaaaactcaattgttagacatctctctgagaaaatgttaataatcaattatgaaaacagtcttgctacaatcaaatattaggtgactttcagtcaattgtatataaaatgagtgtgattggttattatcattttgaaatgttacattgtgcacataaaaactgaattaattattgttatattggaattactttcaataatttatatcagtccacagcagcaaaaatgtctaggaatactaaattgagatggtcgtttttaataggaataaaatattgagatggtcaattgatatgcaaaagttttacttgctaattaaaaaattaatgttgcattttatagaaatctctgatgttaccttgacaacacagaacattctgcatactggcagtgaaataataaagggaaatcaaaaaacacctacaaattgaatgcctaaaagtaaaatcaaataaaatagtaagcttaagtgtgattttcttacatagtataaggatttgaagtttattatttggctttacagcagacagaaatgtttaaataacctatggctttcattgcaaagcagatttctcatgtctccaaacaaataatttagaaagaatttattatgaatcaatagagcaacattccctctagttcattgcacttgttattacgctttctttaaaagtgcccaagaaagaatttaaatttatcactcctctttaaacttgtaaaagcctgtgttaattggatgtcaacctctttttactcacatgcttgctgacattaaggggcatatgatttaaaagcaacctaaagaatatgaagaatattcacaatatttactagcttatagggaaataaaatacaggtcccatctccattaaaccacaaatactcagcatgcaataaaagaagcaatcactttttaaaggacagcaagaagacatattcctttatttaattaaaagttatgagtttcaactatcaagatctgcaaaaaaatgaatgggaagtacttagaaatgtaatagtaaggaatgctacatgaaagctcatgtcaacttttatagtctgtttatgttagattaagggaacagaaattacaaatcataacacatatacatacacaacatttttaacatgtaagtagaaaaaaagtctaatttttcaatattttgaaaatctattgtccttcataagaactcattaatgctttgtaattacatacagagttttaaagacaagtaccacataattgttttaacaaccatgaaaaaagtgggtcagaaactgactccattctggcaactcctcctcattcaaaaaaaatgaagaattcaattcattgggaattattttgggagatagaagcagttgatatacattctagattctagtacaggctaaaaattctgtaaaatcagtggcctggctactaccataaacctgtaaagctgaagaaattagacaatacagaggaaaaaaagcaaagagctgccattcacggggagtgaattttcactatcagtcattaaaatgtacctttattttaaagatgttaggctgggcgcggcggctcacgcctgtaatcccagcactttgggaggccgaggtgggcagatcgtgaggtcaggagtttgagacaagcctggctaacacggtgaaactccatctttactaaaaatacaaaaaattagctggacgtggtggtgggtgcctgtagtcccagctactcaggaggctgaggcaggagaattgcttgaacccaggaggcggaggttgcagtgagccgagatcatgtcactgcactttagcctgggcgacagagcgagactctgtctcaaaaaaaaaaaaaaaattattaatgtgtaagtgtaagaagttaaacaattccataaattgaatagtcatgtaaccagcatctggattaggaaacaggatattactaaaaccccagagtccatctggcacttttttccagtcactagtgatccatacccaaatggaatccctagcctgacttccaacaccatattttattattgaatgttaattaaatttatgtaacatatcttagatgtactgttgtgtacctggcttctttctatcagtagaatgcttattagatttgtccatattaactcatagtagtctgttcattctcatttctatatattattccagtttgtgaatatacaataatttacttttatgtatctctgtttagtcaaatgacatcttggtaatgttcactttggagctatggagaatagttaccatggttaagagttgacttgtcaatatctcttggtgaaaatgtgtatatatttcttttgaagataaacattgaaatgggattcttagcataggtatgtacacagtgtaagtatatacattcaatggtttccaagcggttacactaaattatgaccaaaccagaaatgaataagaggaatagttgtttcttatcctggccaacatttttcacttaaaaaaattctaatagttgcccagtggaatcattttacattttcatgcagactaacagtaacttttcatgtttttaatggccatttggttattctctttgaaaaaatacatttgtcagtttttctctttgctagtctatcattttcttattgattttgagggatgctgtatatattccagatacaaatatttttatatgtaaggactgataatattttatccgactttgaatcttgattttttgttcttttagtgtaatcttctgattatactttttttgtttatagagtttaatttaactattttttttttttgagacagagtcttgctctgtcacccaggctggagtgcaatggtgcaatctcagctcagtgcaacctctgcctctcaggttcaagcgattctcctgctttagcctcctgagttgctgggagcacaggcgtgtgccactatgcccagctaattttttgtattttcagtagagacggggttcactgtgttatccaggctggtctcaaactcctgacctcatgatccgccctgctcagcctcccaaagtgctgggattacaggcgtgagccatcactcccggcctaaaatttttaaaataaaggtacattttaatgattgatagtgaaaattcaccacgcccagctatttttttgtatttttagtagagatggagtttcaccatgttggtctggctggtttcaaactcctgacttcatgatctgcccgccttggcctcccaaagtgcagggattacagttgtgagccaccgcacctggcctaatttaactaatttatatttagtaacttcagtggccttttaataaattattgcttttcaaaaataaagatattcgattttcttttaaagatatttttgtctcaatctttacttttatgtaatatttttaatccatttgatatttattttataaggtgtgacatagaattaaatatttatttttaccgtatatccaatagatacaattaccctttattacagtgatgcctttgtcataaatccagtgcccatatatatgtaggactgtttctggattctatttgtctgtccttgtgcctacattacactatctaacccactctgggattattcttataaaaactgttccttttgttggcagtcacttccataaatttatatacatatagaacaaggaaataaatcttcatagaatattatggatgaaagttagcggcattcatatagttgtattcattataataatcatgctcagattcatgcacatcaaaatgtcatagtgtatgaaatacaaagtgactaccatatctataacccactagcagaatgctgaaaatagcagaaaattaatggctaattcacaatagcatattaaataatactatgttcatgtacaatgtaaataaaactaataggagaaaaagggatatatacagggtaagtatgtttaaaatgagtggaataatcaaagcacaattcaacttacaacacttcaggaggaaaatggaatgttgtagctgcagaggtttatggcatgaattctcatatgattattctaaattaatacatgaatggtcaattttactaaaatagtttgctattcaataataacaaaagaaaaataatgtactatttacacaactaattttgttaattcatattccagtgagttgagatacagacaacattagcagggttaagtgtaagtataatcagtggttcagttcttaaaataaaaccagctatgaaaagaaaaaagaacaagaaaaagatatgtaatatatgtcctcagagggtcaaattaaggcagttaatatttttgaaagaatccatttagaaaataatcagatgaacttaatcacctcaagataatgtaagaaggattagaggaaaaaatgagaagttaaatggatggattatttctctttctccctcactactgtctcttgtctttcctttccttttttttttttttttttttttttgagacggagtctcactctgtctcccaggctgaagtgcaatggcgcaatcttggctcactgcaacccctgcctcccgggttcaagcaattctcctgtctcagcctcccgtgtagctggcattacaggcgcacaccactacgcccggctaattttctgtatttttagtagagacggggtttcaccgtgttccccaggctagtctcgaactcctgagctcaggcaatacccccgcctcggcctcccaaagtgctaggattacaggcgtgagctgccgcgccccggcctctcttcttccttttaaccagactattgaaataatctagagaaaatgcttcactcaaaatattatttccacttgggtgttttatataaatgtatacactgctacacagaacgcttcaccaaggtgtaatacagtgacaacaagaccaaaagtagagcataccccatctgagaaaacaaaatctgaccatatgtcgtggtctagctcctttcccacgcaatttaataagagaataccgtgatttcacctcaccactaactttctcaatcccgtctctttctgtagtcggccattgctttcacatacatctaaatcccatttaggtctaagtcattccacagccttcttatttcatgccaccttaaaggcacaaagacaaatagcaagagacctgcaatttactacataacaattgtcctttctttcattatgtgttcccacctgttttctttcattatgtgttcccacctgttttctttcactcaactctattaggtgaatgccacgcctcaaaaccatgcccctcctataaaaccactactgttttttgcagatacttaaacatctttttctcagaggaatgattttgtaatccttttgagaggggtgtgtgtgtatatgtgtgtatatgtgtgtgtgtagtgtgtgtgaatttcatgtgtgtgcatgtgtagtatatttattttatgccacatacaaaacacataaatagatacataaatgctacgaagtgttttgatgatatttaattgataatatttagtgcatacataaataaagcaaaagaattctagtctaacctagatgtttggtttacaataaagaatctattaagactgtttgcattggaagttagaaccaatgtaattcactaaatacactgaacttaaataatgtttattaaggttgcattccagaaagatagtatcttactgagtttatgatagtcttatgaaagttgcaatgggctttaattttcatcctatgtgagcttcggcaaatcttaaaacttctctgagtcttacataaaatgaagccagtaattgctatttaactgcttcacaaggacttgtgattgtcagattagaaagtttatctcaaaatgattagcagaattttatttttataaaatatgagttatatttgtctaaattaataacacacttgactttgcaataagatttaaaaaataaaaaaacttttcaagcagttcagatacagtgaaattataggttaatgtgctaccatcatttggtttaaaacctcaaaaaccatgttttgtcttttttagctgtatcataaaaatatatgtacaatattaaatatttctcacatcctttatattatactgtatcagtcatatttacattagtgaatccgactgagtaaatcttttctttaacacactatttttttaagcttagtgcttctaacaattatgaaacaacagcataaaaataaaattcaaacaattcagcctggttgatgaaaagagtggcataatgttcctttttccttcatctcatgttctttggttgtttattaattcctttcagtttgaaaatatattttgaaccttgagttacaattcaaacaaaattctcactaccccaattctgataactttatacaattaataacttcatttaagaaaactcctgtaactccgtaagtattctcctgcttgaatagtttaatatatttctctcaacttagctgaaagacataaatatttgacattaatagaaatatcccatgtatgttagatatgttgatttatattttacatcaatttctgtcttctctgtcctctcccataaaactacgaatagaaaattcaactttatattttctaggttactttacagctagggctctagaatgcaatgcaaattcgtttcaatgaatgaagtcttaaataatgttcattaaggatacattgcagaaagacagtatcttagtgtacttttccagatttggaaccagatttttcctgctgcacttttggctagcaagtgatttcaacaagcagggtttagaagcagttgcagcttctagatttaatatttctggccaagtggagtgggtcacgcctgtaaccccaacactttgagaggccgaggcaggcagagtgtttgagctcagaaattcaagatcagcctgggcaacatactgagacccctgtctgcagaaaaaatacaaaaattagctggatttggtagagtgcacctgtggtttcagctactccagaggctgaggtgggaggatcacctgaacctaagaggttgaggatgaaatgagctgcaattgtgccactgcactccagccggggtaacagagtgagaccccgtctcaaaaataaaagaatatttctatgcttttcattcttctttgcatgcccataggaacagtggcagcagaggcagtggcggcagcaacagcttcctacctctagacttttctgtgtcctttatatcagccatactggcagctctcccttgactttcactcctttagtgttcccagaaatttcttaggcatttaataccctacattaaataccttgatatcgaacatgcctacaatgttttgtctttcttgtcttgaaactttgaccgatagtctgaggaaaatcatcataaaaagatttacaagttgcacagccccagaaacatctggaggagtgtgaatgttacagaggttaccttttgaataaaaagagctaacaatggaagagtaggctgaccaagttttgattccacagaacacccatctgaatttttaagtacttttctaaaagaaatcatgagcaataattaatttacaagatatgtgatgtatgataatattgataaggctggaaagaatctgacatcttataaggttgaacatttttgcagaaggattagaattgtattatcttgtgtgaagttcattatggtctcctgggcagaaataaaagggattaaagttcttttatttttttctgttatctttttatagtagatttattaagcttattttaataatttataaaaggaatgagaaaggaaaggtgactttttcattatttatgatatttatagacatctgtttaaaaagacacccaattccactaattttgaaaatctaagtgctgcttctgctttagtatatatactgattattctcatcattatctgtttgattcatctctaatttgtggtagtaatatgtttcaaaatataatgtaaatgaagcatattaaaaatgattcaccattaaaatttataaaagggtattttatcatttaattataatagaatatgatttatttaggaaaagagatctaaatgataatcttcatcttccatataaatagtgagtaactagtgatagtttgacagaaataaatgaccaaaatctgacagattgcatacgttactgtcagccattaaattatatagattcattcttcaaaaaattaaagatagatatttgtttggttacatctgaaaccatatcaaaatagcagtaactgtcagtatgtttgcaattccttttacaattaaaaaatggaaaacattttcaaaatattttttctgttttcccaatgcacgtataaataattatatagagaattgctaatgcttgtaatttaaagaaacatgtttatttttattattttacttgtttcttatgatggtaaaagtcacattcgacaatgcagcatgttaaatgtagcagattttcatttgtccccataaaagggtttgcatttgtgtatgtgtgtgtatgtgtgcgtacatgcatatgtatataaagagagatacatatatgtatatatatgcacatatacataattttacatatatgaacatccaaaacacttttcaacattaacactttattttaataccactattaacttgaagaggaattttgacactcattgacaaaatatcatattactgtctgacaggctatggtctgaacatattcgttttgttaatagctatgtatcttaatcatgtaataaaaatagttttagttgtgtgtgagatttagtactcacattcctttctgtctaccaaactcaattataaaatctagacagaatgcatgaagcagctatttgaggaatctcagaagtaaacaaacagaagcagatgaattggagaagactcaaatgcaaagtacccataaattcacactgagtttaccatttgtttcccttctgctatcctcagcctgaatgcagtggacccaagaacatggaaggtggcgttgagcacacatagaaggaattctgggaacagccctctatttctgattgaggagaaagaattaaattcttaatgcccagagagcgtgcataaatgttccattttcttcctaattttaaaatttattattattattattgattgtatcctagaccctacgcaatcctatggcccataggagctaaattctgaggataaggaatctttctcactgatctatgaaatgttgttgctcttttgtttttcttttttttttttgtcctcctgctacttgcccacaaaagagggcacgatcacagaaatgcacaataaaataaggtaaataaactccaactttttggctggaaaaataatatggggagcccttgagtaacaagagccacagaggacagaaagggaggagcttaggcaaaagaccctaggaagaatttatggacattcaagggctagcctcaaagcatgtatctaattgataataagatatcaaagacatggagaatggaactaacaggcagaccacagcacagttcccagactggccactggctgatggacatgcaggcagattcaaataccactgcaaaggctttcaggcttccaagtcagttaacttgattataaatcagtaaaaattattcagtctgaaccaaaaagaaaaaaagtaaataaattcaaaaaggatcagaaattcaggggtgtgcgggacaatagccaaaggtataacaattgtataattaactgcaggacaaaaaaaataaggtgtggaaaaatatttgaaaaactaacagctgagacttcccaagtttggtgaaaaatataaatttagagattaaagaagctcagtgaccctcacacaaaataaacccatagaaatctacaccaagacatatcataattgaatagatgtggcaaaatcaaactactcaaaaagtaagacaaaacatccttctgttatatgtgagtgtttattgtggctttattcataattgttagaaactagaaacaacccaagtgcacttcaatcagttaatgggaaaacaaagtattctatatcaaaatggagtactattcagcagtacaaaagaatggattattaatgactgcaacaacttagttgcgttttaaagacattatgtggagtaaaagaagccagtctcaaaggttataatgcgtttgattccatttatatgacattatcaaaaagaaaaaaatcaatagggatggaaaacaggtgaatagttgttgggtttaggtttaggaataggatatgactataaaaaatagcacctaggagttagaagaaaactcataattttggtgattgttacacatttctattcaaaatctttataccaaaaaaatcaactttactgtattataattttaaaaataatacaatatccttaaggaccacaaaccaattaaatgccagaaggtaaaaaaatattaaatagaaatcttaatatacaacttttaatttttaaaaattttaattctgtaacattctgtaactaattctgtaacatttcacaagcatgtattactatatttcatatgattaagaatattctagaatgtcatcatgtttcagaaaagcaaagaactcaaattacttaatgtgaggaatattttaattttctttaaaaatcaaggagaagcattaaattagttaattcataatagctatagtgattgtgatcatgttatgcaggatgttgcctagtgttctgtatgaaagttagacactctgaatataaaagcttagttaattattaaactgataataaaatagctatagcattatttattaaataaacccccactgtcttgatccaaggttgcattaatgcactgagtaggcaaaagcttctcattgatccatgtgcagttgcaaataaaaataacattctggaagatttgtgcttcaaattctgatatgttaatatagtgggtttaaatttttgatggccttttctcctgcatacatgaatacacatccacatgcacgctcaaagacagtcaaggaaaacaacacaaggaagaaatggacatacttctctacatccagttattgttaaagatacctttgcccttaatctggaatgtttactttgaaacataaactatatcaaaactgaagagatttatttttataacaaacattatagtgatgagttttatcaatgacaatatgtaaatgtaagcagattcaaagaagtaggaattcaatatttttattagtgaaaattattctgtttagtacacataaatatagatattttaaaacattcacaagttttcagtaatcaaaattataccctagttggattttgaaaacattctaaatcaactcaattattagctgttagtgagagaaagtctatagttctcttctagtagcatggccaaaaaacatagccaagcacatataaatgtgactgtgaattcctcacttatattttactaatctccaatcagctatgttttttgaatcactccctaatgtttccctaatttagctttctgaatcagaaattcactactagagaatttctacatctagcattctttgtgataagcattacatttgtttaactggtatgcacataaagtaatttgtttcttaatgttagtctttaaattataactagactcattcaattttttccaggttaagcttctacagtctttgttgatctgttaataacagatcaataacagttgtgcccagagagcaaatgtattacattattatattaacttttggtggaaattcagagagaagcagcagtagtaatggcacacaaaagatagcataaaggaaagggaaaaaatcctgtcccttaagtctgagtctaatacagaagactaaatataaatatatacagctaaatataacagttaaaagaaacaaacaaacaaaaaaaacacccccaaactcaatgaaatgtatgaagtctatactaataatacctgcctttgatagagaaatagcaaggtggagaaagagaaagagacaatgaatacagggatgtgataattgctataaagatacaggcaattgcaaaggaagcaaatagaagaaacaagttgtgaagccaccacgcattctgctggaggagatggcatttaagcattgtgggtcccaggtagtcagcttggtcctctgtctggaggaagagcagttaaagcaggtatcctaagatacagagagatctttgctttatctcttatcatctaagatatttatttgtgtatttgtatactatacatatatgtacttttttatttatggacagttatttcattggaagaagaaatatggctgcattttcccacatttcaggaagctcctgacacagatagctttagcagcttttgaataaagtgtcccaatttgaatattctgtgctgcagacaccccaaattgcttgtactatcacttacttatatgcgtgggtatgttaagcgggtccttgagaaaatacaaaggcataggagcctttgcttttaaagaagatacatatatgtataagtcacattgtattattttccttttatactcccatcttctcatgagtgtatagtggagtttttcagaaacgacactatgagtgatagcacaacaaactgaatgcagaatcaggcatgagaatctagctggcttctattaagtcacatattataaaaatttcaagttttataaaacatattaaatatgttacataattggcttattcttatttttaatgacttaaaaataaatatagcaaataattgttgcaacttctaatgtggtaaatatagctagatatacccacattaaaatttctttgacattttcaataattttaaagattataacaaatttctgagtacaaaaagtttaataattactggtctagggcaagtaacatcactgtagcgattattatcattttgaaagtaaagattctattatatattaaaaaataaacaactttcatataatgaagtttttttttcctttttttaagtcaaataggttaaattattcctgttccaaagaagggattttatttttatttcctggcaaaaataaaaatgacaatctgtcaacaatattcccttagcacttaatttgaagaagttcataaattaatatttttcccatagtaggaataactaattcactactttttcaaagcaagtgataaagatatctgtatccctattggtgtatctcccaaaggctaagataatgtgaagtttaaataataaagttcaagtaacaaacgtgtttttatgcttttaggattcaaatgcttttacaaatttcttttaggctggaatcagctttataatatttgtttgttaatggctggtaaacaacaactaaaagcactaggaaagtcttggagttgttgttttgttttacttgatgctgttgctttaaatgaagaccttaaacaattcagatgtcactgaagataatttgcaggagttgttggaatcaaagtattctaaatcttctcagtagaagacatattgtttaagactgagggtggagctatgattgagggaacatttgtgcatgcatggcaaagtttgagggaccacaaagtgtgcaagaagataccttcaccttatgaagagccttttctcctctttctatttttagtacacaaatagcctcttgcttgctttcaatgtctgaatgttacttagaattacctctgctctcctagcacatatttaagcaaattaaatatttgtaaagtttataagtttaggattggaaaaagaggaggatgctgttagtagacacaatctaactgtacaatgaaagctacaatgtgtggtcaaagaaagttcatttgtcacagctgaagagaaatgcaggagatggaatagcagtacacagcaggttgtatttttcagggttgtaacaaacacagctatctggaacagtttagttgaaatgtctagccagaaagcaaagttacaattacttttgtggtttaaggataattttatttcatcaaaagtaaaaacaaatatctttatttggtctgggagcaattatttaaggggagaaaatgtgcttttagaatgtatggacaaaattttaatagaaacttgataagttttaatgaatagcaaatgtatcatattttaatatgttgataagtttctatatgtatttggattatataaaatttctgatctagtttcctggtctggctgttctttctgccaacaaaagtgatgatcagtcatgcctaaggaggtcagctaggtccagccaggtctaaccagggacagataagatagaccataatgttggcttttaattttaggaaaatcattctgaaatcaaggtttttattttcaagaatgtgactttcttaaatggacagtaattttgtgaatttttaaatactcaacattggaagcctagagcactgagagtatcaaaatatactatagcatgtggcaaggaataatgtggtaactaatgtatgtcaggttcccatgaaaaaaaaacaaaataaaaaacaggtgaaatatattctggggtcagacagaggatacccagctatggttaggtaggtcccgagtgcttcagaacctgtgtggtgcctcagggatgggaatattgcaatagaaactcagacactttgtaaaaaaaatctgaaaataggtgtttttcccaattcttctttgggcctccagcgggaggcttccaggtagggttacccatatgaatgatgtccagcagtgacagagaagactcagtggcatggtgtcttcaagttgtgagaggcaatgtgggccccatctccactgatgctaactgggccagaccaaggttttcccatatgtgccttcgagttcaagaaattgcttatagactccatgaacttgaagagatctgggatgcaaaatgacagaactttgtaacaagaggcaatggcgggagtcagacagaagtagtagatgtcaacacacatcaaaaagctccattcagtcaattccattcctggtgaatggccaggagaattgaggggaaaacacagattgaagactccttgtagctgccatggtatgacaatactttcctctttgctcgtatccagataccacccagaagaaagaaaataatttagaagaggaataaaggaagcctgaagtaatcttataaagttttaaacttaaaaatttgcagttattttacagtggctttttttcctttgttttggttgaatgggagccagagaaagttaacaattttgttacaagaagaaaaaaaagcaagcaaacaagtaagaaagaaagaagggggaggaaaggagaaggagagaaaatgtctgcacaactgaatctagaggtttaaatatttaatcttttcaaattaattagttttaaaaattattttcctatagatgtatatccaaaattttcacaaaacaaattgtcattaagttatatagtaaatgtaattctctcatgaaaaatacaagaaaacatacataaatatctatactatatatagcaatggctctcattctggaggaaaaaaatatacaatcattgtgttggtctactaagaattctgtaaattttcatatattataattatcttaggttttggtgaatttttcatttattaaatgaaattcaaaccatttaaaagcttcatttaatatgacttgctgtggtattagttataaatgtcaaaatataagtattttattgactgacaaaacaaacatatcaaaaagtaattgatgcaataatgttattataaaatattttataatattagctttattaaagacacttatgaaaagttttctgggactcatattcatcacaacaattttaattaggaaagttaaagattatatctaaatatataaaaccttgctttgcaaattaaatgaggttgacatattatgtatgcttttcttgttcattgcttacctaggctccttgaaaagtgcatgagattatgtgagattaagtctataataggaattcataaattatggaacatttaaaactcaaaactattattattatagatttaatttccttacatcttggtgattgttgagtatcatagtgttgtgtcagcattttatggactttttcctccctttctaatgaggtacatgccaatttttatgctctaagaataactaaataatgaaaatatataacaacagagtctctactaagctgaataataatatattatagctgcaagcttcccttagaatgaaaggacaattgagaagacccagagaacgcatcatgtagtcaaaatcttcaacatccaaagaggagtaagaaactaagtgaacaaacccttgcagttagaacctgagtgtcttattcaaatattattgtagttgatgggcagtgttcatgacagagttactgtgaatgagtagagagagaggatttatgagtctataagtgaaagtgaaaagggcaaagttaacttgagagggggagagaaagagagaaagaaagagaaatgcaccccttagtatatatcctcaatataacagtttataggtgactacattgcacatgtaatgaggtagctttagaaagttaattcatacaaggaaaaaccaatggtcagtagtcaagtaccttgtttaactgtcaacttccccactagggccctgctgacagccattggctcccaactcctgtttcaattaaaaataaaatcttgggtagagaaaatactttaatttctaattgaagttaaaatagttattgagcaaaattttttgtacataatgctgttgaaaaacttcacatgataataatatttgtattttatggtctcttactgaaaatttcagcttccaaagtgagatgttcatctatttaattttcttaagagctttgaattgcctgttcagtcaaaacagaggttttaagtgatggacttttttgtcaggctttttatttaatttctagtaatggatgtagagacattgaatgaaaattcccagtttgaaatagttttatggaaaagaaatccatatcacttataaatcacagtgttcattctcattttatggtgattgtacatgactgtccctgtcattactgccagctagtatttttttacgtctgttacaagaaattattatttctgctatatcattagagtttgaacactaagaaaacctccagaactttgctagggggaaaatacacagcgctttctcggattattaaatttgaaagtaaaatgggggacggggccaagataactggaaaacagcagagttcctaagctgccatcaaaacaaacaaacaaacaaacaaaaacataataagcatgtgaatccttcaccggcaatgaaagtgtccaggttctctcgtcagaagtgactaggaggctgacatgacctatggagagagggaagaacagtgtggtgtggcggcccacctgagagtcacacagggcaggggagccccctcccccaagccaagggaggtggtgagtgaccgtgctacccagacagggaaacagtgctttttccacagaactgtgcaacccacggttcagaagatcccactcacaaacccatgctactggggcctggggtcccaacccctggagcatgcagactcttaacagcctctcagatggaatctgcttaaacctatgaaactcccatgggggacagggggtgggggcaagcagcactactgtcgctgcctgctgtctaagccatttgagctgcttgagggaggagcaacagtcagcactgggtctcaaaacttcctaacgtgctaagctccctgggcagggggagggcaacacccatctctatagctccaggctgtgcttttcccctgctggagccagggagactagacagcttggtcccaagacttgcccctacagcccaacacactgactgtggcagtttgtagccagaggacctcttcaggcctgaccctgatccatccttcctcattgggcagggattccctgcaggaattccaataactccagccagaggctcagggacagaacctggatctccctgggcctgaacccctagggagaggggtggccacagtctctgtggcccagcagatttagcctttcctcctggtagttttgaggaatccagtcagcccagatgagtgggtttccccccagaaaggcacacctcctctactaaggaacaaagtgcttcattaaataggtcctgttccccattgccacccaactgagtgagaccctccaacaggggttgtcggacactctatacaggagcaattctactgccatcagcttggtgtccctcaagatcagagatcccagaagaagaagcaggcttccatctgtgctgttctccagtgtgcttgagtgacctctccagccatgggagtgacagatgaataaggactgaagttaaccccaagcacactgcagcagctctgcagaagaggaacttgaccatggaaagaaaaacaaacaagcagaaagcaacaacaacagcatcaacaacaaaaaagcccccacaaaaactccatccaagtgtcggcagcctcaaagaccaaaactagacaaactcacaaaaaaagaaccaacaacaacaacaacaaaaaaggggaaaacccaaaagaccagagtgcctttactcctccaaatgattgcaacatctccccatcaacggcacagaactggacagaagatcagatggacaaattgacagaagtaggattcagatgataggtaataaaaaaactacactgagctaaagaagcacgttctaacccaaggcaaagaagctaagaaccttgataaaaggttagaggaattgctaactagactaaccagtttagaatggaacataaatgacctgatggagctgaaaaacacagcacaagaactttgtgaagcatacacaagtaccaatagccgaatcgatcaaggggaagaaaggatatcagagtttgaagaccaccttgctgaaataaggcctgcagacaagactggaaaaataagaatgaaaaagaatgaacaaagcctacaagaaatatgagacttcataaaagaccgaaatctatgaatgaccggagtaccacaaggagccagggaggatggaaacaagctggaaaacacacttcaggatatcatccaggagaacttccccaacctagaaagacaggccaacatgcaaattcaggaaatacagagaacacgattaggatactccatgagaaatcaatatcaagacacgtagtcatcagattctccaaggttgaaatgaaggaaaagctgttaagggcagccagagagaaaggccagttcacctacaaagggaagctcatcagactaacagcggaactctcagcggaaactctacaagccagaagagattgggggtcaatattcaacattcattaaaaaaaagaatttccaacccagaatttcatatccagccaaactaagtttcataagcgaaggcgaaataaaatcttttccagacaagcaaatcctgagagattttgttaccaccaggcctgcccttcaagagctcctgaaagaagcattaaatatggaaagaaagaaatggtattcaaatagaaagaaaggaagtcaaatgtctctgtttgcagatgacatgattttgtatctagaacaccccatcatctcagcccaaaacctacttaaactgataagcaacttcagcaaattctcaggatacaaaatcaatgtgcaaagctcacaagcatttctttataccaacaagatacaagcagagagccaaatcatgaatgaactcccattcagaattgctacaaagagattaaaatacctaggaatacaactaacaatggatatgaaggaccgctgctcaaggaaataagagaggacacaaacaaatggaaaaatattccatgcttatggatagaaagaataaatatcgtgaatatggccatagtgctgaaagcaatttatagattcaatgctcttctcatcaaaccaccattgacattcttcacagaattagaaaaatccattttaaatttcatacggtataaaaaagaccccatatagccaagacaatcctaagtaaaaagaacaaagctggaggcatcactctacccgacttcaaactatactacaaggctacagtaaccaaaacagcatggtactggtaccaatatagacatatagaccaatggagcagaacagagacctcagaaataacagcacaaatctacagccatctgatctttgccaaacctggcaaaaacaagcaatggaaaaaggatctcctattcagtagatggtgctgggaaaactggctagccatatgcggaaaactgaaattagaccccttccttacacgttatacaaaaataactcaggatggattaaagacttaaatgtaaaacccaaaaccataaaaaccttagaagaaaaactaggcaataccatttaggaaatagggatgggcaaagacttcatgacaaaataccaaaaacaattgcaacaagagccaaaattgataaatgggatcaattaactaaacggcttctgctcagcaaaagaaactatcatcagagtgaacaggcaacctacagaatgggagaaaatttttgaaatctaccaatctgacaacggttttatatccacacttcacaaagaacttaaatttacaagaaaaaaacaaacatccctatcaaaaagtgtgcaaaggatatgaacagacacttctcaaaagaagacatttatgcagccaacgaacatattaaaaaaaagctcaacatcactgatcatcagataaatgaaaatcaaaaccatgccagtcagaatggcgattattaaaaagtcaggaaacaatagatgctggtgaggctgtggagaaataggaatgcttttacattgttggtgggaatgtaagttagttcaaccattgtggaaaaaagtatgtttgattcctcaaggatctagaatcagaaataccatttgacccagcaatcccataactgggtatatacacaaaggaatataaatcattctactataaagacacttgcacacttatgtttattgcagcattatttacaatagcaaagacatggaaccgacccaaatgcccatcaatgatagactggctaaagaaaatgtggtacatgtataccatgaatactacgcagctattaaaacgaatgagatcatgttctttgcagggacatggatgaagctggaagccatcatcttcagcaagctaacagaggaacaaaaaaccaaatactgcattttctcactcatagttggaagttgaacagtgagaacacatgaacaacaaacaccagggcctgtagcggggtggagggttagggaagggaacttagaggacgggtcaataggtgcaggaaaccaccatggcacccatatacttatgtaacaaatctgcacattctgcacatggatcccctttcttttaaaagaaatttaaaaaagaaagtataatggacatatattaagaaatattattttatattcaatttaaataaatcctagaactttcacttgaacctgccatgttccacagagttgaaaataagagttaaattgatcatgaatttatacatactccaggaaacacagcaacaggatcgcacaatataacctaaatgaatatagtagtttttctgtggtgggatccagtgattctgacaaagcaattgagtaaatttctctttctctattatggagagagaacacatagagtgtaacagaaaatgccaccaagcaagactttcagatatgatattttaaaatgatttagaaaaactctattatttggaatcatttctatttatttaaaatttttaacataaatattttattctaagcaaaccataaatagtgcaattttaggagtcaatgttcacaaaacagcaactctatctctcagtctactctatactgcactgctggcatcagaatgtggctagaaaaaacactactttgctgccaatgcttattcattcatgcctcttactctcaagtgaaaccttaatgagcagttatattatctcatttctgttcattctctaataattctttatgataatttcaccaccaataatcatcttctaaaattccagtaccccttcctctctcctttcaattgatgaactcacttcttatgttacaaagaacatttaaagaattagaggagatcatttgcaagtatctaccagcacatctaactctctgcctacactcatatatttttacattttcttggagttttttacaggaggaactgcctgtgctcccaataaatgcagacactatcactcctgggtcagcttcatgcctgtacttgttcaaggaactgtctcctgcatttcccctttatccctcctgcagcttcagtttttctaattctggaagaaaaaaaaaagatttttttccttaaaacaaacaaagaagcaatgacaacaaaaacgttttcttgaccttactttcccctctagttttcttttacagcaaaacttcttgagagagttgtgtatacttgctgtctccaatttccctcctaccaatcctcaaatccacttgcctctgacattttccctatcattccataaaaactgcttgccaaggccaacactcagatttatttactaaatccaatcttgagttaccagtctccacttttcttcatgaaccagcaacatttggcacagcttatcattaagtcctcactgaaacatttttttttgtattggttttcagcactccatactttccttcatttcatcctacctagtagctattccttctgagtctcctttgataatttatttttatctacacaagtgaccaccttatttaagaacaacccatgaccttctctgctgatgctcagtctagggggagatctcacccaatctcaggactttacatgccattcacaaactattgcccctgaagctgtatgtctggcccagaaatctcccctcagctccagattttatattcaattttctatttaatacttctacctgtattttagtcagtactttaaccttagaatgtacaaaattaagttttgggtattaattcctctgtgtctgttttttcagggttctctaaagggagagaactaataggatagatgtatatatgaaggggagtttattaggagaattgcctcacacaatcacaaggtgatgtcccacaataggccgtctgcaagccgaggagcaaggaagccagttccagtcccaaaatctcaaaagtagggaagccgacagtgcagcctttggtctgttgccaaaggcctgagagctcctggcaaatcactggtgtaagtacaagagtccaatagctgaaaaacttggagtccaatgtttgagggcaggaagcatctaccacgggagaaagatgaccagaagactcagccagaatgctcttttcaacttctgcctgctttattcaagtcaccctggcagctgattagatggtgcccactcagattgagggtaggtctgcctctcccaatccactgacccaaatattaatctcctttggcaacaccttcacagacacacccaggaataatactttgcatccttcaatccaaccaagttgacagagtattaaccctcacagcatccaaagagatctctctgcctttccccttgcccctcaactgagtaaccagatcaccatccttcaaaaatttgaatcagaccatgtcacacttctggtcaatatcttccagggcttttcatctcattcaaagtaaagctgcaattcaaagcctgatgcccctgatatcctttccacctaactccatcttccagcgttttttgttctgttttctctgctctagccccactggccacctggctgttcattgactgcttcacatacatttcaacctcagcgcctttatacttgtagaccctttgtctgaaatgctctttccattgatatccacctgactccctatgttataacacttgtgtctttgcttatttcctttgtgaggatttctctaaggcctctattgaaaattgcaattctaatatagcctgccgcactttttataattaaacattacttttctccatgacatcttacaccatttaaatgatatatttatttaatttattgcctatctctgtcctccatagtggtatttccactagggcatggattgttgtttatttgtttttcccactgtatcaaatatacctaaaaacagaacttggagtatagttggagcttaatacaattttattaattgatttacaagcaaatgcatgtgtgaatgaaaacattcccaaagattgatgccaaatactagggtttcaacttttacaaagagacagaaaaactgaattttgagttttgcaaagtaaacttcattacagtgtctgaatattctatggatatgtttcaggttcaatgttaatcaaatgtaagtagaatacaagcagtagaaatatttacagtaaaaagttaaaaacatcagctttgaaattagggaaaaatggactcagaaccagtcattaaatagtcttgtttttgttttctgggagggaaacagtttagtctgtctaagcctttatttcattttctcagaattgaagattaaaatataaattctctttgaaatgaggattagttgggacgatgtacataaaacctttaatatacagtaagctctcaataagaataccacattgaaaaggaaaaaaaaatctgaatttaggtttactgttaaatatgtcattattgtatcatttttggtgtgtatggatttctctgttaaaaacttttaggtaaatactggttatgagattctggggggttagaatagcattctttggattttatgatgtggacattacttttctacgacattttatagttttgtatataattttatatactagaatctttagacccatattagctattttttacatctttattccttttcattgcctaatatacatagactattaacgtacttgttcagacataaatataaagaatttctgacacttttagcaattacactttataaactggtgataaaaaccatgcacatttatgataatatacaagggaaattcagatttctccaacctctgaaataatgttctttaaaccacaactataatatggcccatggtaaaattaaattcatattttgttacattcatacatttatggggtctgtaactcttttttttcattttttaaaatgccttaagccagtgagaataagtgaatagcttcttgtgaaaaaatttattttaatttaaaaacttatttttaggtagaaatcttttacattttaaattaataaacttacattacagaataatctttcaggtttaaataaaaatgtccaacactagtaacttgcaaaattaaattagtttctgcaagtcatttttcttactatgcatcttattaatatggaaaattgcctcttttcattataaaaatttctgtgtgggactatatcccagctcctacaaagttgtattagcatatgtgaatacaatgaaataagttaatgcagttcttcaccatggaaagcaagtctgcagaaaaatatcatgggagatgacagctgagcttaacctatcccataggcttttgtcactgttcatccttgaaggtcttttcaaaattgtgtgccatgtaatgtgtcattattaaaggtgaactgacttttacagcctttttctgaaaggtcattccagggtaggcacaagatcttggcttccactttgcatgagtttttcacataatgttgctgcatattctctttagtgctttcttaccgcacctccccaccactggcttctcctctttaacattttcacatttctgtcattggcaaagtaagatgatgggaacagcactcacctgggacacttcacaactctgttctagaagtagacagaagtggaaagaaataataaaatcatactcctgttgggcacatcaaaagaggtaatatttaagtgctcatgccaggtaggaccatgttttcaaaggtccatttactacgaagtcaggttcttattgatcattacagtcaatggtaagttgactatcatgacattcattcaattttcaagatttctattgagatttatcatgataatggggaagaaatgtgattgtgagaaaaggataaaagaagagcataaaacagaaaaatatgaaatattggaacacaggcattaatgtgattttatgtctactggtagaggatcctcttaaaattacccagtcattttaaataagttcaatcactcataaagccatttctaaatgtagaaactgtaattgtgccttaggataattctcaatgcaaatactgtaattagtagttattgtgtacaatatgtatacatttctttttctgattagtcagataaaatcctccctcctttatgagaatcgaattctttctcattccaaccatgtgatcctgttgaggcttatcagttactccctggcttaggaaatgggcagctggccacatttaaaacaattgtaatactccactcacatgtagcaattgatctagagataatgagctgggacattagaattgtttctagatgttactctagttagatttatagacaactgccaactctcatttagaagttgtaaggaggtaagccaggagtaactagtttctttcggacagccagttttcgtgaatgaaggtgatattcagaaagagcatagataaaaaaaaaaggagacaatgatttttaccagtgtctgggcacatgggttttaaccatccctaaggataaatctatccatggtttcgcatacataatatattcaggtgagcgaatgggttagtgttacgtttgttgtttttaatgtaatattatatgtagtttggatcttgttttgataaaccaaaaaattcctaacacaaagttgttattatcctcttttttctaggtatagcaatttcaatacaaaaagagcatataaattgataatgtataattttaggtcagcttatctctatgggacacaatatattcacatgaaaagaaaagtttcaatctggtgaatgtctctaaagaacaccgtatcaaatgaattaatttgcataaaataaccatttttaaatttaaatgaaagttctaatacatctcaattcaactttacaacagaaaaatgagtgttgtggtaatttgatttgaaaaagcaaattatcaaatcaaaatacaggctttctggttctctgaagtttttaattattttacagaaaccataacaaaatacctctaagcgtaatacaaagaagaacaaaattcatgttaatatataactgaatataacttaatttgtaaaagcaaataaaagtctaattattttccagttttcctggaaatgacattttgtcactttgtaaaatacgttttgtattttaccaaagtaattatttatacagcacttcactgaaaaataaattctagctgtcattaacctgtcttaaggctcaaaaacaacttcattttgtgttagtagtaattgatagcttacttgagcatatattaatagttcactttattagatagttggtaaaatatctagggatgtcaataacatgacatggcacagaattctatttccagaaaaagaaattcttcaaaataaaggcaaaatatttagactacccctcttgcccacataagtaaatggaaaacagataatttgtttgcagaaaccttgtgttaatgtcagtgctgaaggattgaagagcatgcctctgaaaagaatgatcttatgtagatgcactgaaaggttgtaagaaagtcatagcagtgtacagatatgttcatgaatattcacagagccaatgtggaaaaaaaattatccattaaccatataatggataaaaaatatcttacatgtttatacaacaaaatactatacagtagtaaaaatgtacaaacttaacactgtgcgaccagcttggtgaatctcactgacataatgctgaataaagaagccaactgcactaaaaatgcacagtgttcaattttattcacataactatgtaacttatttcacttctaaaattccttgagtttgaatataaagaaactgaaaacatttcgattacctgtagaaatgttagattgctagaaactgggaggaagcgggggagagaactatgtggtactgggaatattttatttcttgactgttggttacacagctatgctgtttgttataatccatgaattgcttatggtttgtatacattttcatgcagaatattctttagtaatttcttttcttttagaatctccattttctgtagattgaataatttgtaacagaccaatgctgcagatgagacaactagacatcagatggatgtggaagccacagaaaagaaagagaagaactttcttctagaactaagctctctggaacaactacctccccaacacccaccaccaagagtttgcctgtttgagccgtatgctatggacagctttgggtaagggttgatggtaaaggaaagagacacagcagagcttttacctgtcatgtaggtgtaaatttaaaaaaaaaaaactggaaactcgagagtctttaatacacagtcagtttcctctgactttttacagacatctgagaagggggttgtctgtggtaatggactttggctatcaatgggaaatgagtttgctgttacacaaagaaaggtagtatctggagactcctggagtacatccctagactgttgttttcagaggtaaataaaatttaactacataacattttggactgtgtaatgcctcttgaatcttatgagttaccacaggagggaaggtcttcagatgaaacaggaagctattctaataatgggcaacattgaattggaaatcatgcattctgaatgaaaaaagaacatgactttagtctggacctgaatctggattccaaacatatctattacgtggataattaactcgcacttaaacttttgtttaagtatctgctcccgaaatgtagtaatagtcttcatattctctcttttactccccatctcctctctactactttaataaaataaaataaaatctttttcgtaggtaacaaaaggcaagtggagctactgaagcaaagctcatcaggtagagatgattgaggtctctaagaccaaacagccaacattaaaatgacatattttaaaatgtccaatgagtatacaaaagttgcacatggttttgtgctgaaagcaacaaatactgaagtaggaaaaggagtactagaaaatgtttcatgaataccagcttctaatgattctggactctctgcttgtacaaagttctcagattcagtgatgagtgtatactcatgatgaatcccattcacttgaatggttttatctcttttgcaacaaattcttcctaataaaaatattcacaacttctgtaagaatttatctctgatttgaaatgctgatatttatttttatcttcttgaatttaaattggtctcattttttaaagtaactacattaagcattttttttttctgggatctacagtttttcccatataaaattttagatcaaggtttttgtaagagtaattgctatttcacatttttattcaaaaattatataaaatatcctacatttccatttggggaaaaatgtggaaaagagctatcatattgttagtcccccaatgtattttatccttttgaaaaatttaacaagatacataccactgaaaattatatgccttcttgaatcaattaatatagcagatatcatgtactccttttaataatatttgttcataatcttagaaataaatgtatgactcaaggtgcccacgtagatcaaaatctatcatttactcggcccatacttcccttttatttgtctcttcttaccttttaaaataaacttttttttactttaaagcagtttcaaattgacaaagtaatttggagagcaatagagagagttctcatgttctctatactcagttgcccccattattaacatatttacatgagacatttagtaaaatcaatattaatattgttaccacatcaacaaatatagacatattataattaactaaagttcatagtttattcagactttcttagtttttacttactatcctttttatgttccagggtccccttcaagatatgacattatatttagtcctcatgtctcttttgtctcctcttgactatggcagtttcctttattacccttgtgtttgatggccttgataattttgagtggtataggcattttgttgaattcccttcaagtgggatttgtatgatgtttttctgattattttacagtaattatgtttccttgggaagaccacagaggtaaagtgccttacacatcatatcaagagtacataccatcaccatcacttactattatgatattaaccttgatcatttggctgaggttggttagtcaactttatccaatgaaaaattattctttttcacccccacccttttcataatttagcctttggaagaaaattactatgtttagtcaatacttaagagggtggagttggtaaatctacaacttcttgagtgtggagtacctatataaattagttggacttctttatggaaaatttgtctcttctaaaattttttctcatttatttatttattaagtcatttatttatgtatcagtatgtactcatggatattttatacattacagtgtaatctaatactatgttacttataatgttgctgaaatttttcaagctttgaacattaaacaagctcttagttggctcctgtgtctctgacataccccatcattttttatttttttctctcttctttctttttctttcttctttctttctttttctttttctttctctctctctccttccttccttttctttcctttcttttccttctttccttccttcctttcccttcccttaccctccctccctcccttccttcaatccatccatctttttctctttctttctctctttctctctctctctctttctctctttctcattaaaagatactttagaccggtcacggtggctcacgcctgtaatcccagcactttggaaggccgaggcaggcagatcacaaggtcaggacatcaagaccatcctgtgaatggtgaaaccccatctctactaaaaatgcaaaaaaatagctgggtgtggtggcaggcgcctgtagtcccaactactcaggaggctgaggcgggagaatggagtgaacctggggggtggagcttgcatcagcctgggcgacagagcgagactccgtctaaaaaaaaaaaagatacttcagcctcagcctcagcctcagcctcagcctcatcttgtaaattttctgcctagtccgaggcagaaaatacatttctccaaaaagccctattttcttttattggataatggtattagacaccaagagctgggtgtttcagtatgctcgttgtcactaggatgtcattgcttgtaggccttctcagctaagagaaagaaaatatatgtgtatatactaactcatgtatatacagatatctataattatatttatatgtgaccatttaaaccatattaagttaaatatatgtgttcatactgatgtctccaactctaatccattactgcatgacgctttccagcctcctcctcttgcttatctgtaacctcccattaccgacagtgagaaatctggctttcaccacccaccatatatttactacactgtttaattccaggttatggtatcacaattgttaacccatatcttgtgagaaataactttgttaactagactacattgctcgtgtacattttattttacctttagtcttagagattccactcttttccaacattacttagaatatgaacctttcactcgtgccttcattaaagttgtttcatgcatttataatatatttagattcttttgtcataatctgtattctcaactgttattccctgaccttgtacatgattttttaattgcataagttaaggctcactctttctgctgtaacgttccataggctttgacaaatgtataattttgtttatccaccattatagtaccagtcagaatagcttcaccaccataacaattctatgcactttacatattcagacattgcctcctttttctaaactctagaaaatttcttatcttttttcaaatatcgtttttatagttttgtcttttccaaaatattctacaattgaaatcttgtagtatatagccttttaaggttgccttcttttgtttcgaatatgtacttaagtttgattcatgtccctttgtggtggcttaattgtgcatatattttttctataagtaatatttcattggatggataagccatagtttaatttgttgaaggacatctacattactttagtttggggtgattctgaatgaagctgctgtaaacactcgcatgcatgttcctgtgtgaatgtaagttttctaatcagttgggtaaatcacaaggagcacgagtattaaattgtgtgaaattactgtgttttaaatttgtaagaaaatgcctgtttttcaaaatggcttataccattttgaattccacagcaataaagaggaattctttctcaccttttataatttctattctctcacgaatgagcattaaattcttaataaatatcaaaagttttataatagaataaaagcacattatgtgagaagcagtgaaagtttggattgaaaatttaatatttaaattcaacttatagagcacctggaaaaatactaatatagaataacaaattattttacagagaaccctgtggaattagctttaaataaaagataaagccagttcaatatcagcatatcaccccttggcataaaatggatacgggtaaaatgcttaaaaatttattgctttctaaagtttgatagtccacctcatgactacatttgcactttgaatttgacagtaaatatttttatatattaaataaattatagtatatgctgtttaaaattttatgcattataagtattcttgttacaattaaaaatagagtaaccattttacatgcatcccatttttacataatgcaatttttcagatttgcactcttatggagtttttttctcaaatacagctgtttaaataaataatgtacttttcccttgaatttgaaatgttaagttctatcttgtataaggtctttttaagaataaaagtttaatgaaacaaaatcataatcaaaatcccaagcaaacaaaatctcttgagctctacctttacagtatctgttaaattttctactacaaccatcgtaagagatcatttaaagttttttaaaaaattatttattaaaaacctatgccacaaaattgtaactggttctacttttcctgaggtatttttttaaacttcataatgacctaataatcctcaaaacaccactgagaagtaactgaggttatgttatggtattctataaaattcacttttttatatccacaaatggatttttggttttggctttgatcattcttttctgctgacttagacaggagctatcagaggcttattcacagatgggacctttctgcaatagtgcttcaagaacacagtgaaagatgactctattaaaaaatggttgtatccagaaattattgctcaggaataaggattagccgtactatttgaaacaaaaatacaaaatagttccaaattcatgtatgacgtaaaaaatcattatgacattgctagctaatatttcaagtcacaaatcaaatactgtctttggctttaacttttagcaaaatgcacagtgatgatgcatgccatatgcctatgtaaaataaaaacattaaatcgaacacaatcatacacaaccatgataataggaaatacagtatgataactgagcttctcttggatgctggctatcacggtaatttaccactcaaaagtgattgccaacctgtcttatgatatccacggatctgtgttctgccgctgtagtttttgctttcctagaaagtcatacaaatgtaatcattctcatgttgccttctgaattttgcttataaagttagcataaagtattctacaatgactcatattataagtgtacctggaattcatgtctttgtatttctgaatagtattccatctttatgaatatgcaacagtttttgtattcatacaccctttgaattacgtcgggattttctagtatttggtgaatagaaatgaagtcatcataaagatttgcaaaatatttcatgtgaatatgttttattttattttgtaatatgtagaagtgaaattgctgggtcatcaggtaactgtattattacttttatataagactcagaaatcatttgcccaaatgggtgtaccattataaatccacattagtactgtattagctttctggttgttcttcatcctcaacagaacttgatatttgttattttctttatcctcctttatgatggtgtgtaatggcatctcgttatggattttattttcattttcttagttaatgatgtcgagtttctttttatgttcttctttagtgcgttgtcaaaagtttttccattttggggggatagtgtattagaattgagatttgaaatttctatgttaattctggatatcagttctttgtcagttatatattttgcaaatgtagcctgccgtctacatatttcccctaattttcttaagagtgtattttgaagaacgtaattccttaatggtaatgaggtttttctttttacaaaatcatacttttagtgtggaatctaagaaatttcacccaacaattaaaggtcaaagagatttttatctgtatttttctatggaagtgttatagtttaggtttttactttagggttatgatctattatgagttagttttctgtatggtactaaagacagatcattattccttttctgcgtatgagtgttgcagggaaaaacagtctgtgtgcattctctgccccccatttgggtgcataggaatggatcttgagcctagaaccctgtcttaccaagagataaggagcccgtaagacctgtactgggtttatcaccttatgagggattatctttgcctattgcaagctcaatgtatcctcaatgtatctacgtaagcatgtgcatggcatggcacgtggccaaccccattgctccttttgtcctcctctggaaagtcacaggatcaatctgtgacaggaaaggggtgtgggtggccatttggcatacatctgatgcaaggatgagccctcctggccatggggaaacaatgcacacagttgacattgatcttgctctgtcacttctctatgtaaataaagtgttgtccatccaatgcttgactgtgctgtttctcttggtggataccaacatgcaatggctagaagtgtatggagtccttccctgggattgataactagcgcatggtgttctgcagaacagatctcaaatattttcagaacaattgtacaagttaagaaaagttcctttccttaagaagctgacatcatagaggtagaagcagtcaataaacaataaacacaataattaagtatattatacagtatataagaagatggtaagtcctatagtcaaaagaaaaattagaataccataagggatttcagatatgaatgcattaagtagagggatttatgaaacatgggacagatatctgaccttcatgagagctttgttgttaccttctgtgttctttcctgctattataaaatataagaacatctctatattacttcaatgaaatgccctgactttcttcagaaaggtaaaataattataaataataaaatgtaactaattatctcattattaatattgagtgaggcccaagtaacaattttagttatggatcaaacaatgactcattgaaaggcattttatactggactagtttggtctgatacttacaattaaaatacctgagaaaatattgagattcttaaattcttcaaatatcagtttttttattccagaatatattaaagtttttaaaagtaaaagaatgacaaaaatgtagttgtatataaatctttttaaaacataagagacttgaaagtaattaaatccacatgttaaccatataatctattctaatgatctttaaggaaacaagctattgagagaaatattcaaattatgtttaatattgaaagtgaaaagttggcaaatatctatttttacttatctaacgtgaattaataagcaaagataaagagtattatttctgtttatatactatatagggataataactattaatttctgtaatgtattttatggaagaaagtacttgttaaactatctttgtaaaattaaaggcaattatgggagggtgagttaatatttcacaattaaaacacattgatctagttaatgaaagaacatttactagcttctaattttgacagtaatgtattttgatgtttctttgaatcaacaataattttgtttataaaatcatgcaaatattagactgaaatggaatgataataagcaaaggagcaccatgcctcattgaaagaatttttaattacagatcatttaatcaattttcacatctattcagtatctttatttcaattttattgtttaacaggtgaaaaaacttcctttgtttttcctgtgaaaacataattttgtggatattaaacagattataactgtagtatttatttaaagtgtttttctctaagaagggttaatagatttaatatgctgagtgtccaaattagctagcctacatgtaccaattgaagccatgtttcatatgataatgctgaaaatgtatacccaggccatgcaaaccaggggtgtccaatcttttgacttccctgggtcacactggaagaagaaacattgttttgggacatgcataaaatacactaacactaatgatagctgatgagctaaaaattatttttaaattgcatatcattttaagaaagtttgagaatttgtgttggactgcattcaaagccatcctgggccacatgtagcatgtgggttgcagattggacaagcttgatgtaaatagttcagttttcttaattttgtgagacgttgtaggttgacactctttctacttttttgaatcaaatagttgtttttaaaaaagttgatattaacatccttattctgtgttaatgaaatatctactgcaacacgattaaaaaatattcaggcaaattatcagacagaaattagtgtaaagatgcaagtaacaatatgaatatagtgaaatagtattaaataaatcgatgcatttaaaatatttatgtaatcagcctataaacttgagacttctcttttcctagtgaattattttaattgtttctcgatgttgtcactcaaaatagtgtttattttatgtgccttttactatagctcccttaaaaatactggtaaaaataaaaacataaaagtatataatcagcagaattatcaaaataatttaacagcagcacatctattgagtaaaatacattcatgaatcaacctcactaacatattttatctaggctccccctcagtttacctgtataaatggtacagttaggatgtattaaaattccatgttagtaaaataaaccttgaagcagtatctaagaaaatttctggagttgatcaaaggtgtaggtgaagcagctctgacttggattataaaagtagaaagatcatagattcagacccattcttcagatgttagccattgagagcatgattactcttaatgatgctatctcttttaatgcacagacaacagtgcaagaacacaaggattacaaagaatcaagaagtcatgacatctctaaaagaaagtaataaatctccaataatagaccttcaagaaatggagagctgtaaaatgattgaccaaaaattgagacaaattctctttaagaaagtaagtgttcagcactattcacaatagcaaagacattgaataaacctaaatgcccatcaatggtagactggataaagaaaatgtggtacatattacaccatggaatattatgcagccataaaaaagaatgagattatgtcctttgcaggagcatggatggaactagaggtcataattgtgagcaaactaacacatgaagagaaaaccaaatatcacatgtttttacttgtaaataggagctaaattatgagaacacatagacgcaaagaggggaactacagacactgaggcccactggagggtagagggtgggaggagggagaggatcaggaaaaataactaattgatactaggttaaaccctgggtgatgaaataaacaaacccctgtgacacaagtttacctatgtaactaacaaaactacacatgtacccctaaacttaaaattaaaaaagaagctcagtgaactacaagaatatacacatataaaaattaaataaattttaaaaatacataaactaaatacgtttgacaaagaaatagaaacaataaaaaatagaaattttaaatataaagaaagtagtgactgaactgaaaaacttaatagaaagcttcaacagcagacttgatcagcggaagaaaaaatcagtgagcttgaagacagtatgtttgaaattatccagtcagaggagcaaagagacaaaggagtaaaatagaataaagaaagcctatgagagtagcaggataccatcaggagacctaacatattcataataaaagttcaagaaggtgaaatgaaaaaggtttagaaaatatatttaaagaaataatgacaaaaattctcaaatctaaagaaagttgccaacatccaggtacagaaagagcaagcgtgtccaatcaaactcaaccccaatgaggagttctccaatattcataataattaaactataaaaattcaaagataaagaaaaaattatgatagctgcaaaagattagaaaagcattgtgtacaaaggagtttcagcacaactaccagtggatttcctagcagaaatcctgaagaccaggaaagcgtgagacactgtattccaagtggtgaagataaaaccaaaactgccaaccaaggattaccatcaaagctgtctttcagaagtaaaggagaaataaacacttttccagacaaataaaaactaagggagttcatcatcactaatcctgcttataggaatggctaaagggagctctttaagctgaaaaaaagaaagacctctaattaataacgtaaaacatttgaaagtacaacactcaatgatataaataataagagttgttcagaatattttgactgtaatgatggtttgtaaagtaatgttatttctagtatgagggttaaaattcaaatctattaacatcaactatagctaaaataagttgtcaagggatatatattacaaaataatgtaaattttgacatcaaatacaggaaatgttgggggaggagtaaaagtggagacaaaagaaaaatgttagtgattatgtggagaaaggactcttacatgccattggtaacaatgcaaattagcacaacgattatgcagtgctgtatgaggcttcctcaaaaaactgaaaatacaattaccatatgatccaacagttccacttttggatatttattcaaaatatttgaaatccttatgaagagatgtctatactacatgctcattgcagcattatttaaagtaagttataaaaccaatcaaaaagtgttcattaaatgataaatggataaacaatttgtggcatatatgtgtgtacacacagacacgcacacatacacacacacacacacacacacacacacaaaatggaataccaagaatactattcagccttaataaagaaaattctgtcatccaataacatggatgaatatggaggacattgcagtaacagtaaatgaattaagccagggatagaaagacaaatgccacacaatctcacttgtaagtggaatctaaagcaattaaactcatagaaacagagaatagaatggtggttaccagaggctaggtagtggggaatatagggggatgttagtcaaagcatactggggaatgaatatttttaaagtatctattgcatggtataatgaatatagttaataatagtgtattatacatttcaaaatttctaagagtacattttaaatgttctcaccacaaaagagataagtatttgaggtggtggatacattaattcacctgatttaattattccacattgtgcttataacatcactttgtatcccataagtatatgaacgtataatttgtaaatttacaataaaatttaaaaacgaatttataatttagtgaatattttctttttttttttcattttacatcacaactttggagtacacatagagttaaattagaaaatttgcttttgagacagtctttcactctgtggcccacgctggagtgtggtggcacaatcttagctcactgcagcctctacgtcctaggctcaagcgatactcccacttcagcctcttgagtagctgaaagtacaggcatgtatcaccatacctggctaacagttttgatgtttagtagagatgaattctcactacgttgcccaggttggtcttgaattcctgagctcaagtgatcctcccaccttggcctctcaaagtgcctatattataggtgtgagccactgtgcatggcctatttgcaattttattatttaagtagtatggaacctggcattggcacacatacaaggccttacaaagaggggccaactgacttgactaggaagtttcaaaatagtcttgctggattccagggaagaactctaaaaaaaataattgagattatgtgataatgacaacagtaacaaaaccagaataaattcatagacagttttcaaatcagtgactcttccaagattattttaatgttacatctacaagtaaacattgtaaaccatatattaatgtacatgttacagaaaaaatgcaagaaatttaacagttttacttgaggtatagataataatataaaaactgcatcttgatatttaattcagacctcaaaagtacaaattagtaaaattcttaatataaaggtttatgttacacatgtagaatatattgatactttttaaaaaagcagaatgtggaactgatgacttttttcagttttactgaactttaataaaaattcatatttaaaatttgtctctagattttttattttaaaaagtgttatttcagccaaaacattccataactgtctgaagaatccctaaatgctacagaacaatttggcactcaaaaaattaaactgaagtaaacaaagaagaaaatgatttatataccatttataagttaattagactttttataaatcacaagacctgtaatataaatagcactcataaatcaacaacaaaaactaagtaaattcatttttcattttgtaccacagtttggaagtatacatcaagttaaatgagaatatttgctgttgataaaatataatgtgcctatatgtattttaaatgtgttatatttacacattctcccaccatctcaatagttaggttttataagattcattttagcacatttgttatcatacccagggccatgaatccctgaaaagttgcaaagtaactagaagtggcccttgaatgcactcacattcagttctctatatatggaggatattagttttcagaaatattggctatataaaaggaagagacatttaaaagacatactgaagtcactatagaatttttaaaatatgtattttcttcaattaacaaatattgaatgcataattaattgctactaagttgatttgcaaaattttaaaagattttctatactcaaaagagctgaagaccaatgttttacaattcaaaaaattcactaaatattagaaacatgtgacatgtgaaaagttaaaataacaacagtttcatctaagaaagttttggtactgactctgaatatattgaattctggcagacaaagtgatatggtttggctgcgtccccacccaaatctcatcttgaattgtagctcccataatcctcatgtgtcatgggagatacctggtactaggtaattgtatcatgagggtaggtttttctcgtgctgttctcatgatagtgagtaagtctcaagaaattagatggtttcttcacatgctctcttgcctgccaccgtgtaagacatgcctttgctcctccttcacctaccaccatgattgtgaggtctccacaggcatgtggaactgtcagtccattaaactttttatttataaattacccagtcttggatatttctttattagcagtatgagaacagactaatacaaaaggaaatttggaaaatatttaaattacttcaagataaatatgcaagatcctattttcactttaaaaatgagacctctacttgtttattgattctggatgagaaaataattagtgtggacaattttaattaccagaatattttcttctgtgttgtgtaatatagaaattgtgtaaggggaatttgttatgattcccatatagtaatcttcttactaaactgattattaatttgctagtttttagtttctaattttcaattaatattgatatatcatattaacagaatgaaagacaaaacccacaatcacttcaacagatgctaaaaaagcatttgcaaaacttcaatattcttttatgacaaaaactctcaaaatattgagtatagaagaaacataactcaatatgataaaacctgagtatagaaggaacatacctccaggtaataaaaactacatatataaacccacaactagtatcatattgaatgggagaaaatggaaaaccttttctctaattcactgtgtttttataaatcataaatatcccctcattattgttactaagcatagatatcactgtcctataaagtattgccttttggtatgctaaattgaagcctaatggcatgatagagtttatgcatctcctcaaatcctgagctcactttttagtggtcatttactggcctatagaacttatttcataaacttattctcgctatacaaatttccataacaagaaaatgcaacatatactttatatattacattttatcctgcccagcaaacacgcagttcttatgtataaatgttagagttgaaaggactttctgtttgctttgtcttacctgctcttgccagagcttcagccaagacggttttcaaaagtacttgctttattcatttttgggaggtacaagaaagtttaatgtgtttgaattatatttcctggattaataaaagtttgatttttttctttttatttttgtgtgagttggtaaaaaaaaatctgttgaaagtttgcacaacactgagccatgtaaaaggtttttcttttatatgagtttacttcaagatgggaaaaccaaagttccagattttcctgatattaagaaaaatgcatagtaaggactgcaggtgtcagtgggcctttgcgttaaaatacttgcttcctcccaaaggctttgttaaaatttcaaatgcctcagtaaaaaagcctatgtttgctttctatgaaaatacgtttaaacattacataggtcttaataagttaaatgtaataatagagcaaaacctaaaaataggcagaatgtattcagactgtagtcaaagaacaaattgaaaatacatgacaatgtaaagaagcaatatgaaatttaagacctgtaaatttacaccttataataaagatggaaaaagtaaaagagaagcagaattcaatgatattagaggaagagctactttgattaaaatccatttgatgcaatcatctgtagctttacactgtttctcaatttactttagtcaacgaattattttgatgagtatgaaaccacattccctcatttaatcatatttaacaattgcaaataaatagtatacagaaaaaattaaaactataaaagattgaatatgttttttcaaatttatttacccatgacctatatcatttatttcacatacatgcaaaagaccataaatcaaatataacaaaataaatgtcaacagaatggaaatgagacaagttaaaaggaataagcattttaatttgttctttttaaaatgtaatttgttgtgcatgtatgaactgtcaaaagcctttgatcttttctattcgagtcctctaggattacgtatatatctggacatgacccacttgaaaaaacccattaggcaataggtctaaacatagtgaagaaccttcttaaagtaacatgtctacgaattggtagctgtagggttcacaagaattccttccagctttgtgcagatttgtaaatctcaagttgtatgctacagagcctgaaaggcaattatcaaagaaatgagactttactgaatgaactttggcttgccttctaagtgacattttataattaacagttttttttaataatgcctactgtaagtattggtgatatattgatatttccacagactcaacagcctatcaccctctgctaggtacaacctaaattaatgtaaaatttcatttttccttgaagtgattacacaatggtatgttggcaaatcctaaataatcagatctctagggttttacttttgcttaaaagctctgttctatagcatttcctgattttcatgttgtaaatattcccacaagggctgatttagagctatcaatgtaacatcactaaatatgcaatgggaaagccagtgggaaccagctttaccacaccactataacataaggtttatctttcatccttctggtaattatcatcttgaagcaactttacttgtcagttattaatatttggttctggggaaaggtaagtagagcgtcacacaataagaatcattaatactaacccagaatatctcatctcaaaaactgacgtgcaggccgggcgcggtggctcacgcctgtaatcccagcactttgggaggccgaggcgggcggatcacgaggtcaggagatcgagaccatcctggctaacacggtgaaaacccgtctctactaaaaatacaaaaattagccgggcatggtggcgggcgcctgtagtcccagctacacgggaggctgaggcaggagaatggcgtgaacccgggaggcggagcttacagtgagtcgagatcgcgccactgcactccagcctgggcgacagagcgaaactccgtctcaaaaaaaaaaaaaaaaaaaaaaaaaaaaactgacgtgcagagtatatctgcaaaatattttaatgagatgatgtgaatatttctaataattttataattagaattgtttgtttttgaaactaatgcaaatacataatccaatgcagagtttagggccagatattgtgtattaaattattccaataattttttataaaatataagaacaaattatattcatcacaaccacagtcaaatactattggaaatgtgattttcctgaatctagtattcctgctttaaaaatctctttggtccagtgataatctctgttacgcactgtaactaatacttaaaacatactttcacaatgatttcaaatccctaaaatagaaacaatagatgtatttgccaataaagtaaactgtttccagtttgtcaatatgatactaatgtttcaaatttttatattattcataccttataaactagagtggtttagaaaaagaaagttttggttctagtagaaaagcaacagaaattattaaagtaagtaatatgaagacacaattttaagattctagagaaaaaaatgcaggaaaagtatcaccacaaagctttataagtaattctgtattttcatccattttaattaaatttataaatctcacattttcatgtttcctaggtgtctgaaaatatgcttaccaagccagaatgtgtatctaggtcctttacaacttaccactacagctctactaatataatcaaaaccttttaaagattgcctaaatttcagtcaaacaaaatttatttttgcaaatgataacactaaagtatatagaagtacatgttaaaatttatttaattagaattgaggactgtagctggttttgtaattttgacatgaatagcatgcaaagaaaaaattactactagaaaacttttcaattgattttccttctagacatgcagttttcttgtactgttttaaaatatatagactatgtccaaaacaaaatttaaaactgagtaagaatgcttatgttatgtgcttcgttagttgtagcaattacttcaataatattttcttgaaataacaatttacaaaattatgggagttttactaacttattgccttgaatatcttaatgttcccaaatgtctacgacctcactccctttaattatgttttacacagacattctctagctcattctttcacgcagattttaggcaacaagaagcaaatatgtgaacttttttttaaaaaataagacttttgtaataattctattcaagacttttcaagagctataaattgtaaaaccatgggtcaaacaatcaaatgaaggcatttttgttccacaacctatttaaatgaaggcatttttgctccacagcctatttccaatttcagagaaaaaaaataaaaattctaaaaattacctacttttttcaaagaaaaaaatggatgcaactaaaactcaataaccctatagggcacctgaccactaatgtgaagtttgaatgaacacaaggtaccggcttccaaagtaaaccatttattgacatgatattagggataataaaccctcataacacctgcagaccaagacagctgcccatgtctccaccagaacatgatgcatgcacacttatacacatacaccacacctgtacacaatacactttgcctcactcaaatgtaacaatcccagaggaattcatacctgactgaggctcaaaaaatttctaaattagaaaaaaagaaaataaaagagagaggcagagaacagcgtaagcaaaaatcagatgaagaacatataataaaagtaattaatcaatgaaatcatgactattttagaaaaaaatgtattttattttagtatcaaagaaaattgcagacactatgacttctcccttaagaccaaaaaaaggaggggtacaaaaatgaaatacaatggttcagggaagagattacaatatagcaaatagagaaaatatggttgatttcattcaggaaagatgaaataaaagaaattgcagagaataaaattactttataaaaatggctaaaattagaagcacagaagctgagcttgtgaaaacctgggcaacaaaacaaaacaaaattaggaaaacaaattgaataagttgataaaagatgatagataagacagagaaaagaagttgaatatacgcatatattggtgttctattttaaaaagaatattgtatatatttaaagtgcacacgatattttaatagacatacacatagtgaaatgattcattacagtcaagcaaattaagatatcaatcaccttccacagttactatgtgtgtgcgtgtgtgtgtgtgcgtgtgatgtatggtgagagcacccaaaatctactctcttggtaaattttcagtatacaatacagtattactaactatagcctgcatgctctacattggagctccagacttcttcatcttatataactacaagtttgtactttttgacctgtatatccacattttctctccctcttctcctctgtaacaattattctattctgtttctttgtattctacttttcttaggttctacatataaatgatatcatgcagtgtttttatttcagtgtctactttatatcacttaatgaaacatcctccaaattcatccatgttgttgcaaatggctgtttctcccttttttaacgcagaataatactccatttggtgtatgtgcatgtgtgtatgtatatatgtatatgtacacctatgtgtatatataggtatatatgtataaatatatgcatataaatatatatttatgctaaaatttatccactcagggctggtgtggtggctcacaactgtaatcccagcactttggggggcccaggtgggtggatcacttgagcccaggagtttaagaccagcctgggcaacatcatagggagaccctgtctttacaaaaaatacaaaaaaaaaagaaatacctggctgtagtgatgcatgcctatagtcccaactccttggggggctgagatgggaggatagcttgaaccccacagcggaggtggctgtgagccggagatcggccactgcactccagcctgggtgacagagtgagagtgagaccctgtctcaaaaaaaaaatctatcagtggacacagattgttttcatattttggctattatgataatgctgcaaagagcaggggaacacaaatatctctatgaggtgctagtttattttatttttttcaggggatggttggtcatttggcggctcaaatttaattctggaaggaacctctatactctttccataatggctttaccaatttacattcccctcaacggggtacagaggttctcttttcttcacacgttggccagtttctcaaaatgcagctcaaaaagttggaatgttagatgtgtgtttcagggccttctatccttggggtgaatctgagagctggggtttatctgacattcattctgcactaagcctgggagagaatctgtggcaaatcctttcactctggtgcagactgcacactctgagcctggggagatggccgatggaaatgcgcttatttagaaaccttttctttgttgtctgcattctagggagattcacggaggcagagccccatcatcagaataaggtgacttaggaactggctcttggatgggaactattaaagttgaggtgcctgatgcatgcaaaaactcttttcaagaagaatctgcaatcctgctttcattcctgtaggaagctggtggggagaaagcaccgaatgtacccacatactacctattcgggctcctggagctcactgtatacctgccctatctgttccacttccagatgcaggctcattagaagcccagccctcaggcagcagctgggaaagtatgctgacaaacccattttagggagaaactgagagctgggtattctatcccgttctctctgcactgatcctggggtagaacagctggaggtgcacatgcactcacttaaaaccacctcttgtgggtgatcttttccactctcggagttaggtgattaagagtcatacccgcggtggaggggaactgcaaaacttgggatgctctatctatggtgcaatcccttcattggtcggggagaagctgggactttgagaattccttcccattgtactgagctgtggttggggtgggggtgttgcctcacttttcaagcccttttggcgtggatagtttctcagttgcccagtgtgtggaagtctctcaactagattccagctttctctccgaggtatctgatgtatgtgtagatgtttattttctgtgtttgcctatttttaaagtcagatgatttattttattgttatttagttatatgactttcatatatatatatatatatatatatatatattttttttttttttttttttttttttttttttttttttttttttttgagacggagtctcgttctgtcacccaggctggagtgctgtggcgcgatctccactcactgcaagctccgcctcccaggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggcctcttatatatttttgatattaaccccttatcaaatacataacttgcaaatattttctctaatttcatagattgtctcttcactctgtttattgttttgttgttgtttgtttgtttttgctgtgcagaaattttttagtttgatgtactacttgtttgtctttgcttttgttacttgtaattttcaggtcatattttaaaaataattgtcaaaaccagtgtcaaggagttttttccttatggttttgtttaggaattttatactttcaggtctcacatataagtttatttttagttaatttttgtatatggtgtatgataagattcagttttattcactggaatgtggataaccattattgccaacactatcaattgacaatactatacttttccccattatgttctctttatgccattgtcaaagattagtcgactatacacttatgggtttctcttttctttattctcttatatttttctatgtgttttttttaatgctagtagcatactgtttttagtagtatagctttgtaatatagcttgaaagcaggaaatgtgatgtctgcagctgtgatcttctttctcaagattgctttagctatttgaaatcttttgtaatactgtataaattttaggattgtttttctttttctgtgaaaaatgtcattgggattttgatagtgattgcactgaactgttagatcattttgggtagtatggacatttaaacaatagtaattcttccaatccaagagcataagacatctttccatttatttctatctccttcaatttcttttatagattttaatgtaaaaatctttctgctctttggttaaatttattcataagtatttcatttttatttgtggtagtttaagtaggattctttttcttttttaaatttatttcaattggttttgggggaacaggtggtgtttgcttacatgaatatgttctttagtggtgatttctgaaattttggtgcacccatctcccgagcagtgtacactgtacccagtgtataaactttaatccctcacctgcctcccaccctttccctgagtccccaaagtccattgtattattcttatgacattgcattctcataacttaactctcacttatgagtgagaatataggtgtttggttttccatttctgagttaatacacttagaataatggtcttcaattccatccaggttgctgcagatgccattattttgttcctttttatggcttatcagtattctatggtatatatatatatatatatatatacatacatacacacacacattatatatatattcaggtaatatacatattatatatatatatatatcacattttctttatccagtcattgattgatggttctatattttttctactcattgattgatggttctatattgggctgattatatatttttgcaatagtgaattgtgctgctataaacatgcatgtgcaagtatcttttttgtataatgacttattttcctctggatagatactcagtagtgggactgctggatcaaatggtagatttacttttagtactttaaggaatctccacactgttttttatagtggtagttgtactagtttacatttccaccaacagtgtaaaagtgttccatttttaccacttcaaccaacatctattttttttatttttttattatgaccattcttgcaggagtgagatgctatcacattgtgatttcaatttgcatttcccttataattagtgatgttaagcattttttcatatgtttgttggccatttgtatatcttcttttgagaattgtctattcatgtccttagcccactttttaatgggattgtttgctttgttcttgctgatttgcttaagttccttgtagcttttggatattagtccttgttggatgtatagattgtgaaaattttctcccactgtgtgggttgtctgtttactttgctgattatttcttttgttgtgctgaaggtttttagtttaattaagtcccatctatttatctttgttttttgttgtgtttgcttttgggatcttggtcatgaagtctttgcctaagccaatgtctagaagggtttttccaatgttaccttctaaaatttttatggtttcatgtcttagatttaagtctttgatccactttgagttgtatggggtgagaggtgaagattgagtttcattcttctacatgtggcttgcacattatcctgggacaatttgtttaacagagtgtcccttccccactttatgtttttgtttgctttgtgaaagatcagttgactgtaagtatttggctttatttctgggttctctattcttttccattggtctttacaccaatttttgtgccagtaccatgctgttctgctgactatgcccttatattatagttggaagttgggtagtgtggtgcctcaagattggttctttttgcttagtcttgattttcttttcttttctttctttttttttttttttttttgagatagagtcttgcactgtcacctaagctggagtacaatggtgcaatcttggctcactgcaacctctgcctcccaggttcatgtgattctcctgcctcagcctcctgagtagctggggttacaggtgcacaccaccacacctggctaattttttgtatttttggtagagaaggggtttcactatgttggccagactgggctcaaactcctgaccttatgatcagcctgcctcaggctcccaaagtgctgggattacaggtgtgagccaccaagcctatcttgttttagccatacaaataatcattcaaggctactatgaacatctttatacacacaaactagaaaacctggaggagatggataaattccttaaaatatacaacactcatagattaaaccaggaagaaatagaaactctgagcagaccaataataagtagtgatatcgaaatggtaatttaaaagttatcaacaggccaggactggtgggctcgcacctgtaatccctgtactttgggaggctgaggtgggcagatcatgagttcaggagttcaagaccagcctgaccaatatggcaaaaccccatctctactaaaaataaaaaaattagctggtcttggtggtatgcacctgtagtcccagcctgaggcttcccgcttaaacccaggaagtggaggtttcagtgagccaagatcatgccactgtactccagcttgggtgagagtgagactccatgtgggaaaaaaaaaaaaaaaaaagttaataacaaaaaaaacctccaggaccaaaatgattcacagctgaattttactaggctttcaaattagaatttttactttttctattgacagtattgcaaaagatacaaaaagagggaatcctccctaaatcactttatgaagtgggtatcaccaaaataccaaaatcaggaaaggacataacaaaaatataaaactgcaggccaatatccctgacaaacatagatgcaaaactcctcaacaaaataatagctaactgaatccaatagcatatcaaaatgataatccacaatgatcgtgggtttcacataagagaggcagggttggttttatatccacaagacaataaatgtgatacactgcataaacagaattaaaaacaaaaatcacatggtcatcttgatagactcagaaaaagcatttgacaaaatccagcatcccttcatgattaaaaccctcagcaaaatctacataaaagggacataccttaaggtaataaaagccatctatgacaaacccacagataacattatactgaatggggaaaagttgaaagcatcccccctgagaactggaacaagacaagaatgtccactttcaccacttctattcaacatagtactggaagtcctagccagagaaatcagacactagaaataaataaagggcatcctaagcagtaaagaggaagtcaaactgttgctgtttgctgatgacatgatcatacacctagaaaaccccaaagtctcatccaaaaagctcctagaactgggaaattaattcagcaaagtttctggatataaaattaatgttaccaaatcagtagccctgctataaaccaacatctccatttattgggtagaatgttctgtaaatatctgttaagtccacttgttctaaggtatagttcaagttcattgtttctttattggctgtctgtcttgatgacctgtctagtgctatcagtggagtattgaagcactccactcttactgagttgctctatctcatttcttaggtctagcagcaattgttttataaatttgggagctccactgttaggtacgtatatatttagggttgtgatattttccagttggatagaccttttattatttatttatttatttgagacagagtcttactctgtcatgcaagctggagtgcagtggcactatctcagctcactgcaacctccacctcccaggtttaagagattatcctgcttcagcctccctagtagctgggagtacaagcgcctgccaccatgcccagctaatttttgtatttttagtagagataaggtttcaccatgttggccacgctggtcttgaactcctgacctcaggtgatccacctgcttcagtctcccaaagtgctgggattacaggcatggccaccacacctggcctagaccttttattattatacagtgtccctctttgccttttaaaactgttgttggtttaaagtttgttttgtgtggtgtaagaatagctaatcctgctcagttttggtgtccatttgcctagaatatctttttccactcttttactgtaagtttatgtgggattttatgtgtcaggtgagtctcttgaagacagcagatacttggttggtgaattttcatccattctgccattctgtatcttttaagtggagcatttcggtcatttacattcaacactagtattgagatatgaggtgctattccattcatcttgctatttgttgcctgaatagcttgttgttttttttttctttcattgtgttgttgttttataggtcctgtgagatttatgctttaaggagattccattttggtatattttgaggatttgtttcaagatttagagctccttttagccattcttgtaatgctggcttggtagtggtgaattctctcagcatttgtttgtctgaaaaagactgtctttccttctaaccttcatatgcaggttagttttgctagatacacaattcttgattgataactgttttgtttaaagaggctaaagatagggcccctatcccttctagcttgtagggtttctgctgagaaatctactgttaatctgataggttttccttcataggttactcgatgcctctgcctcacagctcttaagattctttccttcatcttgactttagataacctgatgactatgtgcttaggtaatgatctttttgtgatgaatttcccaggtgttctttgagtttcttgtatttggatgtctagatctgtagcaaggccagggaagttttcctcaaataatccctcaaatatgattttcaaacttttaaatttcttttcttcctcaggaacaccaataatttttaggtttggtcatttaacataatcccaaatttcttggaggctttgttcatttttccaaatttgtttttgtctttgtgggtttggactaattcaaaaccttgtcttcaagctctgaagttcttctacttgttcaattctattgctgagactttcagtgcattttgcaattctctaagtgtgttgcgtattcccagacattgtgattgttttttatttatgctatcaatttcactagagattttcctattcataccttgtataattgttttgatttatttaagttggacttcacctttctctggtgcccccttgattggcttaatagttgaccttccaaattatttttctgggaattcagagattttgtcttggtttggatccattgcttgtaagctagtgtgatcttctaggggtgtttcagaaccttgttttgtcatattaccaaacttgtttttctggttccttctcatttggtagactgtgtcagaaggaaggtctgggactcaaggactgctgttcagattcttttgttacatggggtactcccttgatgtggtgctctaccctttctcctagggatagggcttcctgagatctgaactgcagtgattgttatttctcttctggatctagccacccagcagagctactgggctccaggctggtaatgggtagtgtctgcaaagagacctgtgatgtgatctgtcttcaggtctctcagccatggataccagcagctgcttctgtggaggtaacaggggaagttaagcgaactttatgacggtccttggttgtatttttgttaagcacactggttttctgttggttggcctccagccaggaggtggcgctttcaagattacatcagctgctgttgtatagggaggatacaagcttgccctagggtaaggtggggccacagagcttccaagggattatgcccttcatctttggctaccaggttgggtagagaaagaccatcaggtggccgggtgcagtggctcatgcctgtaatcccagcactttgagaagccaaggctgacggatcacgaggtcaggagattgagaccatcctggctaacacagtgaaaccccgtccctactaaaaaaatacagaaaaaaaaatgagccaggctcggtggtgggctcctgtagtcccagctactcgggaggctgaggcaggagaatggcatgaacccgggaggcagagcttgcagtgagccgagatcgcgccactgcactccagcctgggctatggagcaagactccgtctcaaaaaaaaaaaaaaaaaaaaaaaaaagaccatcaggtgatggcagagttaggcgtgtctgagctcagattctcctttggtggggcttgaggtgtcttctgtagggaatgggggtgtggttttcatgccaatggagttatgttcctgggggtattggctgcctttgctgcatcacacaggttgccagggaagtgggggaaagcggccagtcacagaactctcccagctcccacgcagcccgcggcctgaaaggctggtctcactcccactgagtggcttgcatatgatcttatatatactctcactctcactcctggcttgtatatgatcttatacaagttagaaaagcaagctgactcacagtttcttggctctcccacagagcctgcagtggctatccacctccttcaaagggtctgtggattctcttggctttcctggtatgttcccgctatagttcttggagcaaaagttcacattgtgggtctccagaggctgctctgtttatccgaatgggagctgaaagttagtgctgtttcctatctgctattttcctggtattctttttaaatttctttttttagatagtttcgtgttagtgtataagaatgcaactcattttttgtatgttgacttttatcctgcaagtttattgaattagtttattagttctaacagtttttttgatgaagtcttttgaggtttctatatataagatcatgtcatctgcaaatatcaacaagttcattttttttctcatttggatgcctttttcttcccttttgcataatttctctaaaaggacttccagtactatgctgagtaagagtgatgaaggtgaccacccttgtcttatttctgattttaaagaaaaattttcagcttttaattattgagtttataacactgactccgaacttagaaaattgacatgcataacttttgttatgttgaagtgtttcttctattcctaatttgttgagttttactcacaaaaggatgttgaattttgtccaagacttttctgtgtctattggcatgacctttttatacttcattctgttaatgtgatgtatcttgtttattgattgaaccatcctagcatcctaaggataaattccatgcgatcatggtgtatgatcctcctaatgggcttttgaatttagtttcctagtatgttgttgaggttttgcatgtgtgtttattaggcctataatttttttttctgtagtctccttatttagctttggtataacagtaattggctttatcaaataagtttaaattttttggaagagttggagaagaattggctttaaatgcttgatagaattaattagtgaagccatctagtcccgagcttttctttgctggaaaagttttgattacagatttaatatctttgtactttattggcctgttcagactttttatttttacatcattcaattttggaagattgtatgtttataggaatttatccatttcttctgggctatctaatatgttggagtataattgttcataatagtaatattttatgatcctttgtatttctgtagtatccgttttaatgtgtcctcaattatggttttattgatttgacttgtttctcattttttcttgattagcatagctaaaaatgtgtcaaatttgtttttcttttctcaaaatcaactctcagttttgttttgtctttccagtctctatttcatttatttctgattgaagttttcttatttcttcttcctgctacctttgggcttactttgttcttctttttctagttccctgaggtgcaacattagggtttttatttgacttttttttttaatgcaggttttattgctgcagttttattgcttttgctgtatccaataagctttcacattttttaaaaattttcatttgtttcaagatacatttttcttcagttttaatttcttctttgacctattgattattcaggaatatgttgtttaatttggacatatttgaaaatcttcctctgtgtatttattcctgatttcataccattgtggctggaaaggatatgatgattttaatgttctacagtcttttaagacttggtttttggcccagcagttatattgtagtacttatatttttgttgtagaaaaatacttgtataaaaattaggaattccttcatcttaaaatttttaagttaaattcaagttaatttttaaagttatattcaagagtcatgtttggaatagtattcaccagatattacattattattgagagaggcaatgttttcaatctttaatatctaattttttgattttactttttatgaatcatttttaataggaatcatttttactcttagaatgaaaaaataagtaatgtttattccttaaaaccatctagctcaggtgattttgcaaatataaactacatttcttgctctcaagggtatacagagacagggtcaaacaatcaaataataaaaattacacagaaatatatcttgttgtttttctttagctacaaagaaagttatttttgaagacttttcttatggtaaaataaagtgtccatcatatttaccatctgaatcatttttaagtgtaaagttcagtggcattaagtaatattcacattgttgctcaccatcactattttttatgcctagaacttttttatcgtcttaaacttaagctttgtcctcatgaagcagtaactcctcatttatttatttcctcctcttcgccccttgtaacctctgttctactttccgtctccataaatttgacttttctaggtacctcatataagtgaaatgcgtcttgcttatttcacctagtgcactgtccacaaggttcattcaagttgtagcatatatctaaatttcattcctttataaggtttatttatattcaattgtgtgcatatatcacttttgtttatctattgatgcagatatctgttttggtccttgctttcgattcttttatggtaaacaatcatccctctgtatctgtgggctctgcaactgcgtattcaaccgactgcagatccaaaatgtttttttaaaaataaaaacaataaaaataaacaatacaccaataaataatacaaattttaaaaaatacagtataatgatttatatagcatttacattgtattaggtaaaagtaatctagagatgacttaaggtatacgggaggatgtatataaattatatgcacatgttatgccatttcacataagggacttgagtatccacagatgttgctatcctcgggggttcctggaacaaattctctgaggatattgagggacaactctattttcagaagcagaattgctccatccatcatatggtaatattatttaattttttaggaactgccatacagttttccacagtagctgcaccattttacatttcccacagcaatgtacaaggggtccaatttctttacattttcaacatttgttattttcagtttttggttttttttttgaataataatagccattttaatgggtgtgaattgatagctcatcttactgtagttttgatttgcattttctttttttttttgagacggagtcttgctctctcacccaggctggagtgagtgcagtagctcgatctcagctcactgcaagctctgcctcccgggttcacgccattctcctgcctcagcctcccgagtagctgggactacaggcgcccgccaccacgcctggctaattttttgtattttttttagtagagacggggtttcaccatgttagccaggatggtcttgatctcctgacctcatgatctgcccaccttggcctcccaaagtgctgggattacaggcgtgagccaccacaccgggcttgatttgcattttcttaatgattagtgatgctatcttttcctgtgcctatttgggcatttgcatatgttctttgaggaaacgtgtattcaaatcctttgcacattttaaaaattggattgttggccaggcttggtggctcatggtggtaataccagcactttgggaggccgagacaggcagatcacgaggtcaagagatcgagaccatcctggctaacacggtgagaccccatctctactaaaaatacaaaaaattagcctggcgtggtggcaggggcctgttgtcccagctactcgggaggatgaggcaggagaatggcctcaacctgggacacaaagcttgcggtgagcagagatcaggccactgcactctagcctgggggacagagtgagactccatctcaaaaaataaaaaataaaaataaataaaaattggattgttttttcttgttgatacttttgctatattaaaaaaatatttgtccaagaatcccttaaaaatcttaaaatctagttgtattattaactatatgttaatatctaaagctaagtagagtaagaaatttaaaagtagaaattcacagaatcctgtaagcaaaaaatatgtgataacttctatttttttcctatgaatgaatttcttaattacccatttcttataagattttgtggaaatgagtaggggctaaaatatgaatgatactcttactggaatcatttaaagcaacaaaatatatataaatctaggcataaataaaagtacattttatggctatcaatagaaattctaactaccagttatattagttctcaaagctcttaagtttttaaatttcaagagtgttaatctctcttgaaatttttctgcaattatggaattatttttaagttatttattttggatttatgtgaaataatttaacaataatctattcttcctgctttcaaataaatttatattctaacacctaattttgtgagcatattagctataaattcacatgtaaaaaataagccatgtcaaacaatgcaatttttacttatattcatcttttttatgaaggacttcagtaacaaacttatttagttccaatgtcaaataaaaaaaggagatttagagattctccattactatccttgctcttctatactatttcttcccaccatatatgtaaccacattttaaagtattcatcttatccatcttgtttctttttctttcagtgctgtgttcctatgccttgcaatttttctccatatgttgttggtctttatatttttattctgtattttttatattaagaacattaacacttttctacaatatatgttgcaattatatctagattgtttacttatcttttaaaatattgcttataaagtaattttactatggttgggattaatgagagatgcttggatgcctttctaaggaacctagactcttttcttttaaatagaggagtaatttttttgtctacccttcaaaaaattaaacctggcaagtatgtcaaggatataatagacagtagaaagattaaagacagttcaataaaactcaactgagaaagaaatctgttgtgagcccgttcatcactgccacatttgagaggcaacatattaagggatctgtttcagttttgaagatagccactttcgcactgaacaagcttatgctttggggcaagttttttttttctttatatttatcaacacaagttatctcactggaggcacctgacaaattaccacgttccatgaggaatttttcaaagtagattgctatcgcacataataagtttggaatatagctaacaaattcacttttaaaaatgtaataataccatgaaaattttcaaagccactaaatacattaaaaatggtaaaatgaaggaatgtttaataaaatgttcgcattgtaataaaagtgctgattttttttaaagaaggaattttaaagtattgtagaggaagtctagaataattttgccattcaaaaatgatgactttctttggttgttgtttgcctcctcctcttcctcctcctcctcctccttctgactgagtcttgctctattgcccaggctggagtgcagtggtgcactctactgctcactccaatctccgctcactgcaacctccgcctcccgggttcgagcaattctcacgcctcagcctcccgagtagctgggaatacaggcatctgccaccatgcccagctattttttgtatttttagtagagagtgggtttcattatgttggccaggctagtggcaaactcctgacctcaagtgatccacccacctccccctccaaaagtgctggcattataggggtgagccacgtgcccggccattttttctttatgttttctattctttttacttgtcatcaaaatttaaaactattttttaagttttattttaaatacaaggggtaaatatgcaggtttcttacatggaaatattgcataatgctaaggtttggggtatgaatcccgttacccaggcagagggcatagtacctgataggtaattcttcaacctgtggccacctcactctctcccgcctcttgtagtctacagtatctgttgttcatatatatatatgcccatatttgctcaatgttagctgccacttataaatgaaaacgtggtatttgagtttctgttcctgtgttaatttgctcaattatggccaccaactgcatccatgttgttgtaaaatacatgatttcattctttttactgatgtgtagtattccatggtgtatttgtaccacattttctttacccagtctaccacagatgggcacctgggttgattccatgtctttgttattgtgaatagtgtaacaatgaacatataagttaatgtgtctttttggtagaatgatttgttttcccttgggtatgcatccactaatgagattgctgggtcaaatggcaacactatcttaaattctttgaaaaatctccatactgctttccacggtggctgaactaatttacatccccactatgagcgtataaggatttcctttcctccacagcctcatcagcatctgttgttttctgagtttttaataatagccattctaactggtgtgagatggtatcctcttcaagtttggatttgcatttctctaatgatcaatgatgctgagcattatttatatgtttgttggctgcttgtatgtcttcttttggagagtgtctgttcatgttctttgcccattcttttaaatgaggttattcttttttttattgttgatttgtttaagttccctgtggattctggatattggacctttgtcagatgcacagttggtgaatattttctcccattctgtaggttgtctgtttactttgttgatggtttattttgctgtgtagaagctcttttgtttaattaggtccaatttgtctgattttgttttcattgtgttgcttttgaggacataggcaaaaattctttgccaaggccagtgttgaaaagagtatttcctaagttgtcttctagaatttttataggttgaagtcttacatttaaattggatccattttgagttagtttttgtatatagtgaaagatagggttccagcttcagtcttctgaatatggctagcctgttatcccagaatcatttattgagtaggtagtccgtttccattgcttgttttggtcagccttgacaaaaatcagatagttgtaggtgtgtggctttatttctgagttttctaatctgtatcattggtccatgtctctgtttttgtaccagtaccatgttgtttgggttactgtagctttatagtgtagtttaaagtagggtagtgtgatacctctggttttgatcattttgcttagggttgctttggctatttggctattttttttgtttcaattgactttgagaatagttttgcctaattctgtgaaaaattacattggtaggttgataggaatagtgttgaatcttcagattgctctgggcagtatggccatttttacaatattgattcttccactccatgagcataaaatatttttccatttatttgtgtggtctctaatttcttttagcagtgttttctagttcttcttgtacagatctttcacctccttgattagctgtactcctaggtatttcattttccttgtggctattgtaagtgggattttttcactctcctgaacattgttgttgtaaagaaatgctaatgaattttgtacgttgattttgtatttggaaactttactaaagtcagttattagttctagttctagaagacttctggcagggtctttaagattttctaggtattgaaacaaatcagtgaagagagattaatttattcttttcctatttggattttttaaaatttgtttctcttgcctgattgctctgactaggtattccagtactattaataggagtggtgtgagtgggcatgcatgtcttgtttcagttctcaaagggagtagttagagcttttgcccattccgtagatgttggctgtgggtttgtcatagatggttcttattatttgaggtatgttccttcagtgcctagtctgatgagagcctttatcatgaaggaaatttatttttattgaaatcgttttctgcatctattgagataatcatatggtttttacttgtaattctgtttatgtgatgtaccacatttactgatttgtctatgatgaaataggcttgcataccaggaataaagcctacttgattgtagcgaattcactttttgatgtgctgctgaacttggtttgctaatattttattgaagattttcgtgtctattgtgtatatatttatcaaagatacgggcctgaagttttctttgttcattgtgtctctgccagattttggtacaggctgatgctggctcatagaatgatttagggaggagcccatcctccccgatattttggaagagtttcagtaggattggtatcaattatttgtatgtctggtagaattcagctgtgaatccatctggtccagagctcttgtggttgttaagatctttattactgattcaattttagaacttaatattgttctagtctgggtttcattctcttcatgattcaatcttgggagattttgtgctttcaggaatttctctagactttctaatttgtatgaatagagtcattcatagtagtctctgaggttcttttgtatttctatgtggttggttgtaataccacctttgtcatttcctattgcgtttatttgggtcttgcctttctttttctttgttaatctagctgtgggggggggggtctataaattttatttagtcttttgaagaacaaacacttgctttcattgatcttctgtatgaatttttacattttaattttattcaacctttctctaattttagttatttcttttcttctgccagctttgaggttgttttttttttctagtttctttaggatagaaactagaaaaaagttagaatgttaatttgaggtctatctaatttcttggtgaaggtgtttatcactatgaactttccttttaatactgctttagctgtatcccagatattttgataagttatgcccctatttttattaatttcaaagatttttttgatttctgccttaatttcaaagtttatccaagagttattcaggataagttgtttaatttctatatatctgtgtagttttaagatatcttcttaatactgatttccatttttattgcactatggtcaaacatctgcttggtattattttgatttttttgaattattgaaacttgtttatgatctagcatgtggtctttcttggactatgttctatattttattcagaagaatgtatattctatggttatggggtgaaatattttgtagatgtctgttgggtccattggtcaagtgttgagttaaatccagagtttctttgtaagttttctgccacaatgatctgtctaacgctgtcagtggatttttgaagtttcccaccatttttgtgtggttgtctgagtcttcatgtaggtcaggaagaacttgttttatgaatctgggtgctccaatgctgggtgtgcagacatttaggatagttagttcttgttggattataccctttatcattatgtaatgtccttctttatgcttcttaattgtaaaaagtttaaagtctgttttatctaatataaaacatagcaattcctgctttttaaaattttctgtttgcagggcagatatttattcaactttttattttgagcctgcggatgtcattatgtgtgagatgggtctcttaaagacagtacactattgattctcatctttttatccagattgccatttcatatgtgttttaagtggggcgtttagctcatttacattaagggttagtgttgatatgtgatatttttaccttgtcatcatgctgttatatggttgttatgtagacttaattgtgtagttgctttatagtgtttgtgggatatgtgcttaagtgactatttgtggtagcaagtgtcattcttttgattccaagtttagcactcccttaaggacctctcataagtgtggtctagttgaaatgaattcccttagcatttgcttgtctgataaggattttatttcccttcacttttgaagcttagtttaatgaggtattaaattcttagttggcatgtgttttctttaaacatactgaaaataggccccaatcacttctagcttgtaaagtttctgctgagagatctattggcagcctgatgggggtccctgtgtatgtgacctgacctttgtctttaggtgaccttaagattttttcttttgtgttgaacatggtcaatctgacaattatgtgtcttggggagggtcatcttttatagtatatatccggggttctctatatttgttgaatttgcaatctacctctctagtgagattagggaaaatttcatcaactataaactcagatatattttccaagttgcttattctctctccttttctctcagggatgcacacgagtcatagatttggcctctttaaataatgacatgtttcttggaggttttgttcattttataaaattctttttctttatttttgtctgagttaatttgaagaaccagttttgagctctgaaattatttcttcagcttgatgcattctgctcttaatacttctgtttgcattatgaaattcttgtattgaattttcaactcaagaaattcagtttaggcctttcttaaaattactattttgtctttcagctcttgaatcattttactggattgctcggcttcctaggatttggtttccacttcctcccaaatcttgatgagcttccttgctatccagattctgaattccatatctgtcatttccgccatttcagattggttaagaaccattgctgaagtcctactaagcttgtttggatgtaaggggacattctggctttttgaattgccagaattcttacaccgattatttctcatttgggagggttggtgttgctttaactgtaggtaaattgagtatagtcagtttattttacttctgaaagtttttataatgctctgtacagggtctttgttgttgaattcttgccctcggcttcccaagagagagaagcagctgctttttgctgttgtagtttggactgtgatccagtagatagcgcttgtgagcaatgagtagtagataggctcttactctgttgcacgagccttttgtgcatcttctggtttgcagctgtgctctgtattgtgagcaggagagatgtgactttctcaccggctacactcctgggtcacttccgatcactggcactgtgtctgactttttgttgttgttgttgttgttgttaggcgtttcagagtgggggctcccttaggtagaggtttttcagggagacaggtcacactcttactagaccagccctgtggagggaggcacaaccaggtcccacaacagcctgcaacctgtggaactcacctctcttagttttatgggggtgtggcctccttcctccctcaagtgctgggcagcgatcccaacttagtattcctgaatcacgagccagagctcttaggcaccaggacctgctctcagctccctgctccagatacttagggttgagttctggatgtgctggaggatctgaaaggctcctggtctgctaggttgcactcagatggagcaaagcatcagtaccgggtagtgggggctgcattgtgtacatgttcttgcagagtggccaagcaggagcctgggagaggctggcaggtaagtaggcctataggacagatgtaccccaaccctgcagggaagccagccctgtttcttccagttcatctattagctggtgccaaagtcgctcagaggaagatggggagccctgggggatggcacttatggctgggttccatagaagctgtcctatgcacaaagatcactccatacctgctgaagccttatctccacctaatctctggaaccaggataccagaggtctatggagagagtgggcagtcccccagttccttcactcaccccttctccaggacccattcagggccagtagccagcccttccatttgggtacccgacaggggttcccagcttccttcctcttcaggcttggtgtgtgcatcctttttccatccacattcagcattttctctctgaaaatgtgttaaaattatgttggtttagtcaaaattccggtccctctccgtgggagtggcacttcctggttgcatctagtcatccatctttcagaaaaccctctttcattacttttatttttttcttttattttctttctccttttctctcttctttctttctctttcccttatctatcatctatctttctctctttctctctctttcttcctccttccttcctttcttcctcctaccctttattttagttccgtgaaacctcactcttcctttatttttttttttaggattttgagtcatagaaaagtttttcagtcttctgttctacagaggaattcaccaaagtttccttttgatattatatggagtcattttattttattatatcagatacatctgaattttatacttggaagatgtttggtgtaatcgagttgccactgagtggctgtttgtttattataatgtcttggaccttcatcaaactctttgatccatacaacttaataattttggaatttcgtagaaacagctgctttaaaatattttgtgaaaagaagtacatgttgccactgtgactttcctaatcatgggcctattgtgcagtactggggttgctgacgatagagggtgacttaccatcactggataactgtctcctctgtaatgaatgatctcaggtggaaattgacgtaaggtacaacatctgagcactttgagccaaaatacctcttccgtcaaactgcttgtctcgaatcttttaatctataccagtgaccaatcaatcatttactatttaccactgaccaagagtctatatctttatttcagaccatccctctatatacaatgtaaatgccgaagtgcactacttataaatctgtgtacaggaaggatttgttccttcattatttttctttacagtcacccctaagtgccacttaatgcagctccagtattttttggtcccattaacacattaagctgaaccacctgcgaacctggtcccagttttctttctctttcttcaactcatcataaagaaagtttatgaagctattagatgctaaatttagagaggagtcagtgttaaagtgagaagtggcataggattctagccacctatttgcataaattaattctgtcctctggacttacttggtgtgatcccaaaatgttattttcatagtgtgatagattgatgctgtacctgtctcaccttgtgatatggtgtatctgagagatctgagcttatgagaacaggtgcagtcacctaaccttgtggtttatgctacaaagaagagccttgttccaaagcactgggggtatgtattgtgaattgcataaatgggcttgccctttacacagagctgttatgcatctcaagacaagttcattacatatgatacatccactccctgaaataacactgtttgcaacaaagcttttcaccttcttggtaagaaacatatttaaagaagtatgcttctagatagactagagaagttttcctgaattatcctatccagaatgttttccagatattttaatttttcttctttttctccctcaggaatgcctgttactatgcatctaacaaaggactaaaatccagaatctacaaggaactaaactcaacaagaaaaaataatctcattaacaagtggggaaaagataggaacagacatttctcaaaagaagatatacaagaggacaagaaacataaaataaaatgctcaatatcactaaccgtcagtgaaatgcaagttaaaaccacaatgagatgccacatcacaccggtcggaatggccattattaaaaagtcaaaaaaccacagatgtcgacaaagatgcagagaaaagggagcacttatacaccgttggtgcgaatatgaattagtacaacctctatggacaacagtatagagatttctcaaagaagtaaaaatagaaccaccattaggcccagcaatcccactactgggtatctacccaaagaaagagaaattgttatatatatatatctgcactcatatgtttatcactgcactagtcgcagtaacaaagtcatggaatgaacctaagtttccatcaaaagatgattggataaagaaaatgtggaataccatgaaatactacacatccgtagaaaaaaaattatgtcttctgcagcaacatggatgtaactggaggtcaaaatactcagaaacacaacatcaaataccacatgttctcacttataaatgggagacatgtacaaacagagaaaaatagtcaaggctggggactttaaaagaggggcttgggagggacttgagagttgaaaaattacctactggatacaatgttcattattcaggtaataggaacattagaagcccaaatctcagctttccacaatatatccatgtgacaaatctgcatatatacccactgaatctataaaaataaaatgaataaattttaaaaagcatgtttcaacacttcatagaaactctacagtttggttattaacatagaatcttctaggtctcatggtcaagtagcaacagagctaaatctattcctaagagttctttttctatgaacctcaaaactgacagccttaagaattatctaactaataggctaaaacaatattcttaaacatgatatattcttcctccaaaatccaagaagttccacacaagactgtgcctttttgttggaggtagtaggtacaaagaaaaataacttgaccttgagtttagagtacatattctgatgtggactagatcattaaatcactaaagtaataaccaatatggcagtgtaattatgattataggttttatctctgactcttggcagccatgtttgctaggaaattatttgccatggtctgctcaccaaatccaatttacacaatattattacaatagagggccacaatgatgctctgttgaatgccaagatgaaaacggtatcttcttctagagaggatggaggtagtctacccctgtgatacgatagtgagtgttgtctatattttcctaggtgaatttgaactactacatttacactctttgtgcgattaaaaaggacgtatcttccagatcaataaaagcttaccaaaagttacagtaggtattgatctcttctggtaatgatattacatccagcacagagctgcaattgagttttcacatgcttaattatgccgtagttctctgtcgtctgccatgatccatctgtttcctttttaagaactatgtaagtgaattaaattgagaatacaataaggtgaaatatcactgaatcatttgtgtatttgaggcagcattaacctctgctgtttcacccagagtatcatttggcttctgatttactatttttttccaggagaaagatgtgtagagttttagggcttatcagttaccctaattttttcattagggaactcacttcaaagattagagaacaaatgtgaggttgttccagctgcaagttatatttatctaaattatgtactttggtggtggggaaaagaaatgaggtggttctacagcttttttagatccatcactgtgagaagaacttgggctaaaattttatcatgccaccatttaccctcagtcctacagttaagttatgatggcattttggtttccctagaattaatggaggctcaggtcctgtatctaataacctcaaaaagatctgatatccctctttctaataaacagtcacacagaacaatggctatagagatactggtgaaagatggaaagatcagcttttgtatataattgcagtggtgttcaaggttccttccatagaggaactaacttataatagtatttgggcatgagtactctggatattgaaaaacaaattatagttttccattatgttggctgatactagctttctgctcaccagatatttatttttttgttatagcctcactgtcattctatcattcttatctattagccatcattacagattcctgtgggtcacaatcccctggtagacatttagtggcccactgtgataattaattttatctaccttattctggacggttaggtactatcggctaatctctctaatttaatcacaatgtgatgattaattttatgcatcaacttcgctaggccacagtaccttgatatctcgtcaaatgttattcaagaagtttccatgaggtatttttttatataagattaacatttaaattagtagattttgagtgcagcagaatactttccataatatgagtaggcctcacccaattagtttaaggccttaatggaaaagaataaataaatagactcacctcctctgaagaaaaggcagttctgccaaaaaacctccctggatctccagactgctagaccccctgaagattttagattcgcaagtctccactatcagggccaattccttcaaatagatctgtctttctgtctatgtcttcctctttctctctttctctctccatacgtatttatatattatttgttctatttctgtggagaaccgtcaccaataaaacactcttgtttacaagaatggactcaattatatgaaagtatctcctaccttcaaccatagtctacagctgcagctgccactgactatggaatgatacacatgcaaaatatttgtgctttggtgaagggcatgctttatggactctctggaagaacattaacatagggtgagttctctattctcacatggtaaaatttattttaacatgctccagcctttaagcttactgacatcttcctatatattttgacaacacatttctagcatttccaactcattttctataggccattgtcatgtctgaattttaagaaatggtccctgaagggatttattatcaactataggtatcatttttattatattaaaaacaaaattatgagaaagtgtccctttgtccataaacatatcctccagggctttattctgtctctggtcaacacctctcacttcttttcaacaccctcaatatctactctcatcatgttccctcaattcctgctggtatgtagtattgaagtcctgcaactattttagtaaacaagctaatgcatcctatagctgggattacttttctctactcaaactgtgcaaaaaccagacagccaatggcttatatgccatggagaggtatgatagatcttgaaaagaatacacatgatcttgggagtcatctgacttaggtatggccttaagtgttcttcaatgaatggcaaggaccttttcctttggtaaagtgtttccttcttcttcctgtctccaggattctgggatatcttagggtgtaaaagtgccaagtgcatatacacagatgttcttgtccacatctctagctcccactccttccttttcttttcctgtctatagcttagaagacctgccagactttgttttaagaacatgtcagcctctttttccatcaatgctcttatgattaaatcctgggccttatcgccaatatgattttctgtccagcttcagaagatgagattctctgccaaggaggtcttctggtttccacccatgagctgagagctggcacacctgagctctgtagtacttcccagatgattaaaagccaactctacaatcactacaattactattttaccatatatttaaagtgctaaagttaatgcataaacagtcttccattttcaccagtatctcactttaatctattatagatgagagtcttacgaattgttattcaacagcatgccaggagtagcacaaggtcttttaccataagcaaaatggtttttattgtcatctggcaagtaagtagtctgatactgggcttgcactatgatttttttaagagctacttgtgctatctacagatttatttgggtttactctagaagtatgagatcatgagacaaggacttgagtgcaaataagttattttgaatgtgatctcaggtagtacatgtgaaaaagtgagaagagtgacacagagaaggccagaaaccaccccctgctcaacacacaatgtagtgctggttattatggaggaaactggcaaccgatcctgtgtgaaatcatacacctcaaaatcttgttatttgagcattgagacattttcctgctattatccccattgttatggatggaattttgtccttccaaaaagttgttgaagctctagcctccagcaactgctaatgtgaccttatttagaaataggctctttgcagatgaccaaattaagatgaaggcatcagagtaggctccaatccaatttgactgtgtctcttggaagttgaaacataggaacagatacacagagaaggagaatatcatgtgaagagcacccagtttgtggtactttgttgtagcagcctaagaaacttatgccaccattgaataagcgttgaccacaagaaatttaatgctcacattttcctagttgtatctgcttgaagctgagagaaaacgtttccttagtgtcagccagagatcacctcaaacggagaagagaaatgctgtgattgaagtgataggtaccacgtgtgctgcaaaaagcctgctgtagctcctggtgatctaaattgaaggatgagacttgggagagctcaccaacagtatcagtgacaacactgcacacattcttatgtattctcacttgaaactatcgtttgtttttattttttggttttttttttttgtgctcctgagcaccttgaaagtaagattctcctatcaaaatcataaaatcatagtgataagattttgttaagtacctattgatgaacctaaatcctcaggattagcagtaggactcaggaactcttaaagatcaagcatagaatgcaaaatctaagaaaaaattgtacatgggcagaatttatgaatgacctccaatgacctttatctttgtataaccccttccactttgagtatgagaaaacccatagatatcttcagacttcattcctatgactatgttatgttatataacacaattgatcttaagattgggacactaccttggtgggcctaattcagtcacctgagttctttaaaaacagaacacttactccaggtagtggcagaggaggaagacagagaagaaagcaggagagaaagtcagatgaatttgaagcattaggggaggttaatgtgccactgtttctttgaaggtggaaggaccatatgagaagaaatgcaggcaaacttcaggggtcaagagagatgcccagctgacaaccaccaagaaacagggacctcattcttgcagtctcaaggcacagaacatggtatcaaagctgaattaggttggaagtggattcttttctagaacatgtagataagaccccagccgtgctatcaccttgattttggccttgtgagaccctaagtaggaataagctgagacttgccagaattctgaagtggagaactgtgagccaatttgtgtttctttaagcgtctatgtttctggtaatttgacaacacagaaattgaaacttaatacaaatagtaaagtgtgtagtacatttttatgcttttaaaatataatggtgagggatgtatatgaactattttagttaatgcacatatcttgaacaacactgattttacccagtgttaagttcatagtgctaattagcaaagcctctactgttgatactaaaacaagaacaacaattataaataagtaatttaatagtttctagtggtctcattggagaggaatctcataaattaaaaaaaaatagcagaatcccattcgtcttgcggtgtgggtgggtggtagagaaagttggaggtgtgttaaattctcttaaatgggtaaagatgacagtgagtgtggtagttctgttctgttcaccaaatgtttccacttttattctatatcatggcaacaatgcactttctaggcttcatgtggttgaatggaaccttgtgacttggtttgtccaatgaacttgaagtagaaattacatttttcacttccaggctagacaattgtaaatgcaatatccttccttgctctcttttttcctcacccggtaatatttgaaatattcactcaggttcttctccctggaaacctaagtaactacaataataagcacggttgtaggtgataatacattttacaaggaagaaatagatgcttgtaaatttaaactatgaagatttgagaattacctgctaccgcaaaattaagtagactattctgaatgatgtagaatgtacacacaagtgaagatttagagggaactagcaaagattatgcttcatgaatccaggtctgggacatcatttctatctcagaagagtatgggacagttgtgttcagaaatgcaggcaaagttgaaggccatgagagagtttagccccaacagtgtgaaagcatagggaaatgcctactgctctgggaccaaaatgggccttagcataaatactctcttcagggaatgctatagcagagtaaaagcagcaaaagcgagagtggcttaaagaccaaggaaaggggcatactacttttagattgttaagaattaatcctggccagacatggtggctcacgcctgtaatcccagcacattgggaagccgaggtgggtggatcacgaggtcaggagttcaagaccagcctggccaacatggtgaaaccccatctctactaaaacatacaaaaaaaattggctgggtatggtgatgcgtgcctgtaatcccagctactcggaaggctgaggcaagagaattgcttgaactgggacccgggaggtggaggttgcagtgagccaagattgcaccactgcactacagcctggactacagagcaagacaccatctcaaaataaaaaaaaaagaattaatcttggccgggcgcagtggctcatacctgtaataccagcactttgggaggctgaggcgggtggattacttgaggtcaggagtttgagaccagcctggccaacatggtgaaactccatctctactgaaaatacaaaaattagctgggcatggtggctctcgcctgtaatcccagctactcaggaggctgaggcaggaggatagcttgaacccggaaggcggaggttgcactgagcagagatcatgccactgcactacagcctgggtggcagagtgagactccatctcaaaaacaaaacaaaacaaaagaattaatccaatgtctttgaaatcgtatatttgtttatacttaatttaggcccaacctttaaatttaatggtgattctttgtttaaactcagatttagacaccacaaaattatttgagtcaagattaatttattacattgtatgcatcacttaaaaatactataaagatgttttaaattaaacaaatgaagatattgaacatgttttgagcgtgttttttctttctttttattgctaaacatctctcattacagacctttcttggcatttatttcttgactgtagacttcattcctttactgaagaattataatttatgtcacacatataaactctacctctaaaacttttattgtaagcaaagctactgataaattatagagattcatgggaacacgaaaagtctatgtaatttctattcctaaagattgtgctaacataaatgaaaacaaaggattatttaaaattcatgtttcaattaaaaatgaaaataaaattaattgttttactactatattttataaacttactttgatttgctgcttcagaaatatttcagtgaaatatgttgtttttttctttcaaagtattgtttcccctttacatatatctaacaatgaggttatttttaaactcaaaagacatacaatcccctgacagaatactagatttagagaacagtgatagtgtatcaatccatgtgtttgaaataaactccatataagcagtaaaaatggtctgcatgaaattgctaatgaaatctacaattctaaatatatgcttttgtccttaactttcaatgatttagtaagctatttatgaaataaaattgttacatgaattgtttagtttcctagaatgaattatatcaggatgacaactaaatttatgtccttttatttgatatactatcattttatttatattggaaagatatagataaaatactgtgtgaaagagtttaatgattctgaaaatttcccatcttctactcatcagcttttcaatattctttttccccttgtaagttttctgactatcagttttctatcataagtaaatgaataacaattttataaatcatcaaggtcattttagctgatgaagcaaaaatagatcacttgcattgctactttaaagtcaagtgtttcattgagataaaatacgaatcatttcccattttatagtctatcttgtgttaaatatttgaaatatatttgaagagtatatttgatagacataagaaagttgttcattatgttataaatttttaaaacatatcttgtgctaaatttttgaaatatatttgaaaaatataattttataaacatcaggaaatcattaattatatcaacaagtgttaaaaatataaggaagcaatataataacttcaggttggtatccgaccttttcaagggtactgcatgatttgattcaatatacttacagtccaacttttacggagaaaaatattacaattatttgcacatgaaggcgatccaatgattatgctatttctaggttacctaaggcaaataggtgccatttggggaccatgaaggaagttgtatcttaatcagtgttagcaacaccttagagtgcataggaattacttagttaaaattgtggaatcctgaccaaacctatagtaattctgatttggtagacctgagctatagtcatgaaagttctgataaatatatcatatgtgattttgatggtaaaatcccataaatccagtttcaaaaagctcttttataatggaattttagccaaagtcacctaatgctgttatgttttcacagtgtggtacacccatgagaccgtgctaccaagttggaaagattttctttttgtatatttttttcttaataaaattatatttattttaaattcaaaggatacatatgtttgtttgttgtatgggtatattttgtgttgatggggattggactttggtgtatccatcactcaaatattgaatattatccccagtagttaatttttcaaacttcgctcctgcctaccctttccttttttggagtccctagtgtctattattgtcgtatttatgtccacatgtatccattctttagttcccagttataattgataacacgtggtatttgactttctgtttgagttgtttcactaggataattgcctccagctccatctatgttgctgcaaaggacaccattttattttttatggctacttcacattctacggtgtttacaccacattttcttacccagtcagcagtctgtgtacacttaggttgattctttgactttgctattgtgaatactgctgtgataaacatacaagtgcagttgtcttttttatataaaaatttattttcttttgggtagatacttagtagtgtgattgctgggttgaatggtagttctacttgtagttctttgagaaatcactgtactagtctccatagaagttatactagttctcattcccactaattgtgtataagcattcccttctctcagcactcatccatgtctgttttttgactttttaacattctgagtagtgtaagatgagatctcagtttggttttaatttgcatttctctaatgattagtgacgtggaacattttttaatgtttttgttcgatgcttgcatgtctttctttgagaaatgtttgttcgttttctctgcccagtttttaaattaggctgttttcttcatattgagcagtttgagtttcttgtagattccgggtattagttctttgtcagaggcatcatctgtaaatgttttctccaactctgtaggttgtctgtatattctgttgattctatctttttctgtatagaagttttatggtttaattcccatttgtctattttttgttttgttgcatttgcttttagggtcttcttcatgaattatttacctaggctgatacccagaatttttcctaggttttcttctagaatttttatagtttcaggtcttaaatttaggtctttaattcatctggagttgaattttgtatatggtgagagtcagggatccagttttgttcttctgcatatggttagccagttttctcagcactatttattaaatatggtgtcctttccccattgtttatttttgttgactttattgaagatcagttagttgtagggatgaggctttatttctgggtgctctattctgttccattgatttgtgtgtctacttttgtatcagtaccatgctgttttagttattatagccttatagtataaattgaagtcaggcaatgtaatgtctcttagaatttatttggctatttgggctcttttttggttccacatgaattttaatattgttctttctaattccgtgaaaaatgaaatgaatctgatagaaatttcattgaatatataagtgtctttgggcaatataatcattttaatgatattggttcttccaatctatgagcataagatgtttttctatttgctggtgtctttttcaatttctttcatcggtgttttgtggttcttcttgtagagatctttcactgctttgattaagtatattcttaggttttcttagtgtgtgtgtggctactgtaatggaattgagttattaatttgattctcagcttgatcattattggtgtatagaaatggtactaattttttttacattgattggatctgggaactttactgaagtcacttatcaagtctaggagtattctgtaggagtctttaaggttttgtaggtgtaggatgatgtcaacagtgaaaaaaaatttgactatcgcttctttaatttggatgccttttatttttttttctcttgcctgattacactggctagaaattccactactatgtttaataggaatgataagagtagacatctttgccttgtttcagttcttaggaaaaatgctttcaatgtttccccactcagtatgatgatgattattggtttgtcatatatggctcttattattttgaggtaagttcctttgatttctaatttgttgaggacttttatcataaaaggatgttggatttttatacaattatttttgtatctatagcgatgaccatatggtttttgttttaaattctgtttatatggtgaatcacatttattgatttgcatatgttgaaccatctttgcatatctgaaatagagcccatttgattgtaatgaattatcttcttggtgtcctgttgggtttggtttcctagtacttagttgagaattttttgcatctatatccatcagggatattggtccataggtttttttgtttgtttattttggagttattgtgtatttgactgattttggtatcagggtgatactgtatttgtaaaatgagttatagataattttttttgtcagttattttgatacgatttttcaataagattggttatctgccattctttgtatgtctggcaaaattcagctgtgaaactgtctaatcctgggcttctttcgttggaattttttttattactaattgaatttcatcacttgttattggtctgttcagggtttctatttcttcctggttcaatcttgggagtttgtatgtttccaggaatttatccattttctctagattttctaatttgtgcatatatcttcattgtatttgtttgtgtaatggaaacccaactattcttgtcaaattgttcaaaatcttcattacactgtatagacactatttaatcaaggatatgtaatttataggcttaaacacctcactgactaactttatactttcaaatgggaagagttattcactgcaaatggcaattattataaactttcaattctcagaagtgttttgaaaattaatgttaacaaaacagtgtcaatgaatgacaaaaccaagatgttacaatattgtataaatataaatagagaaaattgcataagaaataaaattcaacaatatttttttctgatagaattaattgcaaaaggaattacaaactcaattactatctagagatcttagttcatttgataacatatacataaacaaaggtatggaatactttagattggctggtttccggaggactgaagagaaaagcacttgatcacaagaaagaaaacagatttatctaattttttacttatagttataattgaattcacaaataaaatttaatttacattactgtaggccctaggattaatcaaagatgctaacagtgtcagaaattttagacttctcttaaaatcttcataatgaccaaatgagacaaaccaggggcagagaaaacacataattcttatgtgtcaggcttgtgggttgtgccttccacattaattcacatgtttaaataatttatattttatgtaattaccaatatacttgatattaagtcttccaatttgctttttattttctgtgcctcccatctgttctatgtgcagtttatttttatttcttgcctttcatggtttgattattttttaataatttcatttgatcactagtattagcattttagctatatgtctgtattttattagttaattgttgttctaggatttcaaggcacatcttttacttattgccttctactatcaaataacattatattacatcaataataatgtaaaaatcttaaaatatgaccagtatttgctctctctgattctttgtgctattgttgccatatatttttcttcatatggtataaaaataacattattattatttgtttaacagttataaagaaaaataatataaaatattgtatattcactttcaaaagtatcactactagccatctttattctttcatgtagatccatacataaatcaggtaggatttttctgttgagtaataaacatccttaacatttcttgtagtgcaggtcaggtagggattcattttctctgctcttactgatctaaaacatttttatttagtggagaatagaattttaaggtgagcatttttattgttttgtcttttgtagtcagtattgtttaaaatataaattaattaaaatataaatgtattgtcatctggtatgtacaggttttagtaataagtcagctgccattctattctttgtgcttctgtaaatgcaggctttgctttttaatttgtagttttaaattccacagtttcatttaccattagtataatacaataacatattttcagaaagagagagacaacattcacataactttcattacactgttgttataattgttctatcttattattagttactgttttaatcttttatggtgtctaatttatatacaaattaaactttatcataggtatgtaggtacaggaaaaaaatatagtatatatagggtttagtacagtctgtgctttcacgcactcaccagggcttttggaatgtattttccctgtagaagggggactactctaatgtgttctttgtctttgtttttgttgttctgtgtgtcatgtggtttcagagaagaataaatggggaactgagacttccgtattcccctcataatagcaagcccaattcccctcagcagtatcactggagaccatgttggagcttggatttctaccctcacccagcaataaggaggtactcctcccctttcttgcgagaggatgtctcacaagcttagtggaacccataaatattaacaccaccccaaagtaacaaaggtattagtggaggccacatggaagcaataatgaggtgtaccccttactctcagccaagatatgtaagtggaggtctactggggagtctgaactcccatcctttatccagcagtaagaaagcagtccctagggtgtaaacaatggccagatgaaaaacttggattctactcccacctgacaacagcaggtggggtattctcttttctcctactggtaggcattatagaaagtcagctaagagagaagatctaaaggttactcaaagtcttacaatataataataaaaaatgtctaggatacaagggaaaactctcatcataccaggaaataaaataatcacaacttgaacaagaaaagataataaatgccaacaccaagaataacacagataaagagattttccaaaaaggatctttaagcagtaacaataaaaatcactaaacacttacaaacctgtttgaaacaactaaaaagaaaatcctagcagaataatagagatataaaaagaaccaaatgtaaaacttagatttgaaaaatacaatacatgcaataaaagatgcaaaagaagggctttacagtggaatggagaggacaaagaaaacagccagtgagcttgaggataattaaataaaaatgacccgcttggaataacagagaacatagactgaaaaataattgttggagactcaggaatttgtaggactataacaaaatatctaatatttgtaaaatggaagtatcaaaatgagaggagaaaaaagggagggctgaaaaagaattttaaaaaataattgctgaaattcccacaaatttggtccaaaaagtaccttaaaataaaaatgtgtgaaactgagtgaacctttgtatcagataatccaaagaaattacaagaaacattataatcaacttttgaaactaaaaagaaacaaacaagcaaattaaaagcatccagaaagaagcaatatattatttataagggaaaaccaatctgaataaaagtggatttttcatgaaaaatgatgacatcctaaaagaaaaagtactatcaaaccaggattctaaatccagtgaaaatattccttgaaaataaaagaaaacatcatgacattttcaaatgaaaggaagctgagagtatttgtcaccagaaaagttacccttaatgaaatagccaaaggaagttcttgaaacaaaatagaaattatttaaaaagaaactccggaacatcaggaagtaagcaaaaaaaaaaaaaaaaaaaaaaaattgcaaactttaaaatatgggtaaacagaatagacttgacagtttcttgagttttaaaaattatatttgacagttgaaacaaatgttaaaacattgatgtcattctcaatgtatgtaatgaaaatatttaggacaattctatagcaagagtacaataggaaaacttaaaggcagatgttttctgctttttttttttgagatggagtcttgctttgtcatgtaggctggagtgtaatggtacgatctcggctcactgcaacctctgcctcccggggttaaaaaaatcctctcatctcagcctcccaagtagctgggactacaggcacctgcgaccacacctggactaatttttacatttttagtagagacgggtttcaccccgttggccaggcttgtctcaaactcctgacctcaactgatccaccccttggcctcaagttttctacacttcatacaaactagtaaaatgttgacatctgtagattgtgataaattttatatgtctaatgtaatacctagagtgattagtaaaatatttatacaaaagaggtacatacacatggttagtgctgaccatgggttacatgggcttggagagaggaacatgattgagactatcaaagggttccatgacagatagctttgtgatcacagagtatttttaaatttcgtttgtgtcagtgcttacacataccttcacatgtgttaaaatggcgtggaacaatgcacacaatgcattaaaacactccctgtttttatattgagaaattaatggtgagcagaattataattagcacacatttagaaataaatgcatgtaatctttttcacagtaagggaaaatgcctctaataaggtaaagcaactaaatttgtgaaacttactctaaaacaaaaatgtggggtcccattttcaaaaaaagttattaagaaagtgctattaaagttactaaaatataaaggttttttgcattcttgttcaaatcaatattatatgttttacttgctatttaattgtttaatattatctaattttttaatatttattttttatctttttaaagacaaggtcttgctatgttgctaaggctgaccttggtcataagtgggttctctctcagttcacctgagatctggttgtttaaaaacagggcacctctcccacctcattctcttgctctctctctcaccatgtgatgtgtctgctcacgtttgccttccaccatgattaaaagctttctacaggctgggcacagtgtctcacacctataatcccagcactttcgaggtcaagttgagtgaatgacttgaggtcaggcatttgagaccagcctagcctacatggtgaaatgccatctctactaaaaaaaatatgaaaattatccaggcatgacagcacatgcctgtagtcccagctactctggagactgaggcatgagaattgcttgaatccaggaggcagaggttgcagtgaggcaagatcatgccactgggtgacagaacaaaactccatctcaaaaaaaaaaaaaaaaaaaagctttctacagctctcaccagaagccaataagatactggcatcatgcttcctgtacagcttgcagaacgaccagccagtcaatcttcttcataaattacacagcctcagggatttctttatagcaatgcaagaatggcctaatacagcaaattggtatggaggagtgggtgttgctataaagatacctgaaaatgtggaagcaactttggaactggttaacagtcacaagttggaagagcttgagggtctcagaagaagacaagaaggtaaaggaaagtttgaaacttcttagagactagtaaaatggttgtgaccaaaatactgatagaaatatgaacagtgaagtccaggctgacaaggtcttatggaaataaagaggtgattgggaactggagtaaaggccatctgtgttatgccctaacaagaaacttggctactttatgttcatgtgctagggatctgtgtaagtttgaagatgagagtgatgacttagggtatctggtggaagaaatttctaagcagtaagcattcaaggcctggctgcttctaacagcctataatcagataggggagaaaaggaatgacttaaacttggaacttacattcaaaaggaaagcagaacataagagtttggaaaatttgcagcctagccatgtagcagagaaaaaaaaaaatccaagtaggatgtggagcaaccacttacttgcagaatgagaaattaacatgactaaaaaggagccaagtgctaatattcaagataatgggaaaaaaaaccctcaaaggcatgtcagagatcttgaagacagaccctcacattacaggcccagaggcctgggagcaaagaatggtttcagggcctaagtccaggacactgcaagcctgcacagctttgagatactgccccctgcatcaaggttgctccagctccagctcaaagggtcccaggtacaccttggaccactgctccagagggcaccaactataagccttggtgccctctggaggaggtggtaagtctgcaggtacacagaatgcaagagtgaaggaggcttggtggcctccacctaggtttctgagaatgtatgggaaagcctgggtgcccaggcaggagcttgctgaaaggacagagcactcacagagattttctactaaggcaatgccaaggagggtatcaccttgctctagatcccagaatggtagatccattagcagcttgaatcctgctcctgaaaaagctgcagacactcaactccagcctgtgagagaaacttcaggggatgcatcctgcaaagccacagaagcagagctacccaaggccttggaagtccaccccttgtcccagtatgctctgtatattagtcaattcttgtattgctataaagaaatatctgaggctgtatagtttatgagatttttcaattgggtcatagttccgtggactgcacaggaagcctagtggtatctgcttctgaggaggcctcaggaggcttacaaacatgacagaaggcaaagcaggagctagcacatcacatggaaaaagcaggagcaaggagtggggggatgccacacacttttaaagaacaccttgtgtgaactcagagcaagaactcacttatccccaaggggatagcccaagccacacatgagaaaactgctccaacaatccaaactcctcacacaagaccccaactccaacactgaggactacatcgcagcatgatttggaggggatacgcaatctgttatcactctggatgcaggacatggagtcagggataattttggagtttaaagatttaatgactgccctgctgggtttcagacttctgtcgagcttattatccttttcttttggctaatttcttcctcttgaaattgtcatgtttagtcaatgcctgtactaccatcgtatcttggacgttaataatttgttttgattttacaggctcatcagtggaaggagataagtctccggtgagacttaggactttggacttgaggttggaacaagtttaagacttttggagactactgacagtagatgattgtattttgcaatgtcagaaggatgtaagatttgaagacaggagaagaatgatgtcctttgagtgtttgtcccctcaaatctcatgttgaaatgtaatcctcaatgttggaggtagggcctgaggaggggcgatgggatcatgggagtggatccctcatgaatggtttaacatcatttccttggttataagtgacttcgcccttaagtggttcacatgaactctggttatgtaaaagtctgggacctccctatccctcattatcttgctcccactcataccatgtagtgtgcttgctcccctttgccttccaccacgattgaaagctttctggggccttcatgagaagaagagcacatgctggcactgtgcttcctgcatagcctgcagaacgctgagccaattaagccccttttcttcataaactactcagcctcaggtatttctttatagcgatgcaagaacagcctagtacactctattatttcatatttataccacacacgcctacctggggtcactaggaaatgtttctattatactattttgaaatttttcatacagtttgttagaattttgtggtttaaaaaaaactggaaaaagtctattgtaagcaatcacttatgtaataaaataaatcaaataaataaatctttcattattttgtacgactatattttattggaaactgctgtgagatatttctactggtacaaggatataaaagtgtatattttaaacttctttgtgattaaagggaattgagagtctacaatcctgctaatgttgatttattccacttctctaaaaggaataaatacgattttttcctccattatacacttgatttggaactgttctgatttcaaatacattacaaaaatgtttcaaaataaactcatcatgatatctagagaaatttgagtaaatttcagttcattctcatttgtctaatgctttctttcaaataattcagaaagctcattttgtaaaggtcatggtgaaatattctggaaagaatatcaaaaagaatattttcggtgttttaaaaaggaaacaaatgcaatgaatacatggcagtagagaagataaagaatacaaaggcggacataattcttatagaaagtaagtttctcaaaagcccacaagtgagtaaaatataaatctagcacatgaacattatctgctagcttccaacttactatcgaattataaaactgtcattcaccatctgtcagtatccatgtatggatatttgtctttgtggtgtcactgcagggagctgtaagtatcaccattactattcttaatgaagaccctgtctatgggcatgcctcctgacagcttctgtccatatcattcattattgtcagcctacagccaagtgccaagtgaatacaggctgtatcttatgcagtcattccttaagaatatgttccaaaatgctaacttctaatcaataagtatataacaagttgattcttcctttaggcttcctccaatgaatattttgcataggtttaaaaatatccctgaaaattcacacacttctgaacattgatgccccagattttattcaaactcctagaatggtgtttatgcacaaaataattgaaatatcctacagtatgagactggttcaaatgaattagatgcctctttgacatcgaatatcctttttctatgcatagataagcatgtaagacctcccataattcaagtatgttatagatgtcaaattcttacatactctttagtattcacacataatgaatgttacactaataaataaacatcatttctttttagtccctgttattggactaaaaccttgcaatttttgatataagatattcacatttccactagaacattctttcagaactgttgacaaattttaacttaaggaaacagggaggcaaagggcaaatttctttaacagtgcacagagctctaaaagttttctaggagattgaaggacatatacaccccaataattcactggctctaacagaatgctgtatcaaaggcataaacaggcctatacactgaacaatagttttactacatcagtttcccagttttcttagttgctatgaaatctgaaatcaaaacaatgttttatgcttttgctccaagacataaaatcaaggaaacctagaagaaactctgatgggagcaagaatgcactgtcatagtaagagtagatttttagaaaagagccttcagtgtgtcaaagacctttgtgagtatgcatatgtgtaagtacatataacaatacaaagaaatcattggcaaaactagaaattatgctaggagggtttactgaagcaaacgtttacaaaacagagcaaactacccctatgcacttaaagactgtactacatctatctgcttatctatctatccatttatctataacttatctttctaatttgtctatcatatatatacttatatattgtataaaaatgaataagaaatggcattgaaaaagagatacctgtgtctctgtcaaatttgttgcttcaacccaatcattctgtagaaaatcaaagagcacatttaatctctttcgcctatctctttaaaaaaatggagactgtatatcagaatttgtcttttctgtgtacttaagaacatggcaattttagatacagcaatatccaaagtttattcttcaattttatactttccctttgcatatttattctatcatttttcaaacttttagggaaaaatacttatcatattttcccagattagtaagcttgcaaatactatcaacatatcttcttgtggtctagctgtggctacatggacgaagaaagggagaaaggaaggaaggaaagaagtattcaaatgagaagatgtaatcttttaatttatctattccaaaagctaataaaatattagtcccttaaccctgtcatccaatgaaaacataaaatgttttcttacttctagagttcaagcaaaaaaaaatcacacatttttaaaggtcatagtaattgagtagcagaaacatttattaacagtaaggctgcttaatgcagactgaatttatttattcactcttgaggggccgttagattgtacaattctgtaaagtccttagtatgagaatggcatcagcttcagaaacctaagaaatagttgaactggggagacaagtaaataaatacaaagagaaaaacttactgggagcacagaaatatgtgcgctaactctttttgagagaaccgtaaaagattttttttggaaaatattaattttgttctgtaatgtaacacatgaaaaaggattgttagagaaaattatatgttggagtactttttgtttacactggaaacaaaacatttctgcacaatggtctgttgcttaagattcctggagaatcacttctgtgtttagatagttttttaataattaaaaaattaacatttataaaattagaaatagttgtattattttatttaatatttctttatgttgaatatttaatgtccatgaattaatctttaaattaatatgaagtaaccattaaatatttaaaaatattgaatttccaggaaaactccgttaaagactccatcaactttaggacatcccaaattaattaaaagaattgggcttcgattttaaggaatatagaaaggatatagacaaatacataccataaagtgactaaaagaagagaacaaagttgtcttttgaaagagtggaattcagacacactatctaaacagctatattatacatgggttctttgtttggacagtattaacatttattgttcagaaagcacaattatttaaatacatataataaagaaattaaatctttgaaaatctcttttggacagaaaaagccagtaggtggacctatacaggtatcaaattagaatctatcaaacttgaaaactaaatctattgaataataaaaatgacaatcttataagataatggttaactaaaggttctaactaatatgaaaatccttaggttttaaaaaacttcagagattaaataaaaacaacaaaaacatcataattaagatacatactaaaatgccaattaatggtaagagttacattaacttaccaggtttaaactcatgctaaatcggttttagaggattgatttcattattatcctaaaatctgttggtgtaacagaatgactgatatgtgtctgagtatatatatatgtatgtgtgtgtgtgtgtgtctctgtacatatgtatgtgtctgtatatatatacacatatatatgtacgcatatatatacacacatatacctatatgtatatatattcacacatgtatacgtatatacacacatacatatatacgtatatatacacacgtatatacgtatatatacacacatatatacgtatatactatatatacacacgtatatacgtatatacgtatatatacacgtatatacgtatatatacacgtatatacgtatatatacacatatatatgtatatacgtatgtacatatatgtgtatatatacatatgcatatgtgtatagatatatacatattatccaattctagagcacatttgcagaactgctgagtgcccagttaacccagattccagactcattggcaagatatatatatatatacatatataatgtgtgtgtatatatatatatatacacacactatacattatatactatatatgtgtgtgtgtgtgtgtatatatatattgctcatgagtctggaatctgggttaactgggcactcagcagttctgcaacatgctctaggattgggtaatttcagcttagctccttcatgcatctgtagtcagatggcagttggctggagactggctcctgtaggatagtctcactcacatgtctggtgattggctctctgtctgttgggacagtaggattctcaattgtctctcatcatccaacgggttagttagcctggacttattctcatagtgtctgggcagcattccaagatgatgaacaaaagacctcttgagacatatgcctctttcactgcattctatttgtcaaaagtattcaaaagacaatcctgattcaagtgagccacaaaagcagacagattatatttctagaggaaaaaacatgagaagtcacattgcaagtacgagtgattacatggaaggaaagcattccagctactttttcaagcaatctacatttctatgccattaaatatttacatcatcttttgacattttgtgaaatatgttgatgtaagcagggtatagattatagtaaattttgaaatctgaaaattactcctctaaataatcaaatgtaggaattatatggtctaagaaaactaatatatcctggtattgtgtaaatttatttttgaaatgatagattagagcttaacatgtgagacaacacattgagcagagtctgggagtgactacaaaacatgctcctaaagacaaagcgaagctgcaaaaagaatttggcagctgcaactgtggaagggaaaactacacatctgtaaatgtgtaacaattttaagaagagctaagataattttgtatctgcaactagcaacttgtaaatttcaaaaaggcattagtactagaaatacatatccttgcataatctgatagcattttccaacccaatttagataaaattaagctttaccaaagcagaaagtgcagctattctacaagttataatcatgacaaggaacgacgtactgaacagtgagtatgtgtttgaaagtgaggaagaggccgggcgcggtggctcacgtctataatcccaacactttgggaggctgaggcaggcggatggcttgagttcaggagtttgacactaacctgggcagcacaccgaaactccatctctattaaaactacaaaaattagccaggcgaggtggcatgcacctgtagttccaatcacataggaggctgaagtgggaggatttcttaagcctgggaggtggaggttgcagagagccaaggaagaaagaggaagaagttgtgactttctccttagggattttctcatcgagatgcacaaagaaattgtattgtaggcaaatacttagacctatactacttattttatatattaaatactattacaattttcatacatgacttgtgaatataattctactaaaaatagcaattactttgtgccagacactgtgcaattttttatggtgttcacaatatcatctaaaggatgagaaatgttttcatctacattttatacaggagtaaataaagcctcggagaagtgcactttatttatttttcaacaattacatagtaatttacgtggtttcaaactcgagcaatctgacccttgaaattgtattctgaaatctgcaagttttatcagtacttcaggaaactaaatattactgaggtgaactaataaattattttatttttttgttgaggttttcttctatccaaatttggctaaaataagagatgaaaataaatgataaaaatcaaacacgtatacaattaatatctacatggccagtgggtgtgtaaatcaccttctgaaggcaatttggctttctctttgtacccttttgtttttcctactaagataatgttttctcctttacgttcctccttttcaccttttctgtcttctcctttatgctaatgtgtgtatatatgccatatttggcatatgttttcctgatctaccttctagtttattgctcatatgttgtgtctaatgtgccttgtagactttaaaaaatatggatgtatttcattttgttcttactttatacactttaacttctacactttaactaaaattttaatttaattaaaaaacttttttacctattttttcaaatctgtcttttatatatatttttaagtttatcctctatgtttttaaatagcctgaatgttacttcatatacattgagttcatgaaaaaaaaagtaatacatatgaaataaaagtatttcatagtatttcatatatattaaggccaatacctatgcatattgtatgtctgtgtatatataattaatattatataattatatacacacatttgtatatataattttatatatattaaatatacacacatatatatgcacacatatagtgtgtgtatactatacatatgtatatattatagtatatatatgtaatataatcatatgtatacacatacacatagtgtgtgcataattgcttatagtatggataagtattggatatgatattgatattgttatttatttatatacacacatacacgcacctaggacatatacatatacaaatataagtatttttctgttgtatgttgtttctgttggttctttatcatatggtgtagtttctttgtctgtctgattatcttcgactctttatggaatattgcatgtcaaaaactatctgcaggaataatttaagacataaaatgaatacgtattcctccagagagaatttacacttgtttttacaaagtttctggagacattaccaacataaggacatgttacataaaattcaaacttaatattagaaattcaatccaacactatattattatgtgggctttttcacttattcattcttgcattaagggtttagttcatagctgtccaggcttatcatggagaggttatactgctagaccacttgcaaaagccctaggatattatttcaattacctttgttcgctgaggccataaaactaaacgttttactttcccttaatctgagaatgcctttgtagcaaaaagtggtagtgatatttgtgtttgtttctagtgttctcttaactttttacttggtaaattattactgtcttgtcactacttttgacttttgtcagaggcatgcgaaccagagcaacatcatcttgaataggagctgggtaaaatgagactgagacctactgggccgcattcccagatcttgaaggcattctaacttacaggatgagatcggaggtcagcacaagacacaggccataaagatcttgctaatacaacagtttgcagtaaagatgctggccaaaacccaccaaaaccaagatagcgatgacagtgacctctgatcgtcctcactgctacactcccaccagcgccatgacagtttacaaaagtcagggcaacatcaggaacttaacgactatatggtctaaaaagggaaggcatgaataatccaacccttgtttagcgtataatcaaaaaataaccataaaaagggacaaccagcagccctcaaggctgctatgcctatggagtaaccctcatttattcttttactttcttaataaacctgctttcactttgtggactcaccctgaattctttcttgcgtgagatccaagaaccctctcttggagtctggatcagaaccactttccagtaacattttcatgatttaagattttaaaaattagtttatcaaggatttggttgtttatgtgattttcagcgattttttatttggaaaaatgtcttgaatgacctaactactatctctgtgaacaggaaatttctgaatgcatatagtgattaggagacttttgaaaggaagaaaggattaaaagtctgaaatacctgaaagcaaagaatgggacttctatgaaagagaggaaaatggtacagtaaagcaagaccagagactccagtgatttaaaatggtaattttcgcagttaactttatctatgctttagaataaattctctttagatttaaatttttatagagctataatcttttcttgaaaatatgaatgttaaatgttaccctacatttacatggtgaaggtaattaattatgcctacatcaattgaatgtcttagaaggctattcgcaatcaattgagagaatatgtatgcattgtcaatatgtccttggaaactgcaactttaaggaaaatgatttttaacaaaaccatttttttctcattaacattatagagaaaggacattaaaggaaatgatattattcaaggaactgctgtgagtcatttagcataacgttagagtttccaagaacctaccaatgacatgaagtgagaacttactgttctttattggtatgtcaacaacaaaatcttttttatttgtaatatgcatgggtttaaattgggcaaattttcagaccttttttcttcttagaactgagagcagtaaatacgactttgtccagaatgaagaacaaggtgaagaaaaggtgtatgagccaactgagcagcttttaaaaaaacatcatttactccttgttttaatttatgcatatttttcagaagtcatacaaaaataatatagaacattataataatattaaatatataaatatgaaatagatttaaagaaaattctccttttaaaacttttctttttttgtttacggaggttaaaaatgacctttgcagggacatggatggagctggaagccgttatcctcagtaaactaacgcaggaacggaaagccaaacactggattgtcttacttataagtgggggctgaacaatgagaaaatgtggacatattgtggggaacaacacacactggggcctgtttgtggggtgctggggggggagagcattgggaagaacagctaatggatgctgggcttaatacctaggcaaggggttgatctgtgcagcaaaccaccatggcacacgtttaccggcacattttaaaaatttacaaattttacacaaacctgcacattttacacatgtaccccagaacttaaaataaaaaattaaagaaaaaatttttctaaaaaaaactcgatttcattttttttaaaggctaaaacaatgagattttttttaatttaaatactctagatagggttacaggggggaataaaaagttctcatttatcaaatagtcttacagtcttaaaatataatttaaaagagactaatacatgcagcaaacctaagaaacaataacctcagcaaaatagcagcattaacatttgaaatcaaagcaatgaggccctgactgctggagcagcacattgaaaaacattctaacattaacaaaacaaaacaaccaaaagacaaacgccctgattgaaacagaactcagtgggatggtggtttgttgttgtcattgttgttgttgcttttgtttctgaaatatttcacttctccagaaaaacttgactgctaatatatgctggttacatttgatttaacacggctgttaatcatgttactatcagaagttcagaatcgattgaatatgcccttggttagctatataatgaacattgaaagcacctgtcaccaccattgttgattgtatggagtcctttgtgtgcactgcaagagaggacagccacatgggctttttggagacatttctagaacagacttagaggcaattctttgataggattctgaagtctttccctctttgatcttatttccttgatatcaaacaataatgcacacaggctttacagtctagaaaagcagctcagtcttaggttttaatgaaggcacaagggagggaggtcaaaaatgtgatgggttaatattgggcagaattctctgaaacaaggacccagcctagacaagctatgaaagtctccttggcagacagtgttgtggctcatgcctgtaatcccagcactttgggaggccgaggtgggcggatcacgaggtcaggagttcgagaccagcctggccaatatggtgaaaccccgtgcctactaaaaatacaaaaattagctgggtgtggtggtgggtgcctgtaatcccagctactcgagaggctgaggcaggagaatcgtttgaatccggaaggtgggggttccagtgagccgagatggtgccattgcactccagcctgggcgacagggtgagactccatctcaaaagaaaaaaaaaaaaaaaaaaaggaaaagaaagtctccttgacactacagggaagcatatatgggattcagtgttgcacatttgtgaagaatgctgaatctggagccagcctgccagggttagagtcctggcgtcgcattacctagctatttgaccacgggcaagtagttaacctgttttcaatttcttcttttgtataataaaaataatacctaatctgtatttttgttgttgtcattgtttgtgggtttgtttagagaaatgtatggaatatagcacatgctcaataaatgggaagtatacataagaagaattccgtaagtacaaaatgattatcctcacacatcaatctttgagggccatgaacaatgcaatttcctttggctcactttttcttaattaaattctgttcaggtatatttctattaaagttatgagctttatttctatattgctgaccaaaattttaacactgttattggggcatggccctagaatctgcttttttcagatggattctaatgtttcgattattttgtcttttcaaattcttctattccaaaatctatgatatatatgaacttctctaattaaaacaatttaggttgcagtcagtctacaattaaatataccaaaacgtcttgaaaacatacaaactttcctaatttaagcaattagaagtaaatttgtttgagttgtggacagttttctgctttcaaggactggtgtgagtttaaaacctcactgttttaaagttttatggagggatcagcattttatataaaaacattttttcaccataaattattttttcttgtgcttcattcttttaaaaaattaaacactctctgactctgaaaaatgtttctcaaaaatagtaataaatgggaataataaaacagatttatattgggaaaaatagctcttattcatagttctttctttcctttaccttgaaaacttctggctctgtgaatgagtaggtgtttacattgatccatctgttatcctaaaaggactttttccacccatgtgttctttttgcttataagacttttttctacccaactagaataagagcaggtttttttgtgtgtgaactacagcttatttggcactccagctacatgaatggaaagtaaaaacatagtgagagagaaacagacctagggcactcaatcacagagatggcatgaagatgttctgcttaagggaaccacatgagaggtaaatgatgtctccggaaatttggagatattctcttgggagacctccaccagtcacttctaggaagcatgcctctgtcctgacaacctgccgagctctcagtttgtgtattccacaacgaacgaggggcacttgtgaccaacaccttacagaaacagtgctctgaaagttggtaaaaatgaaagtagaggtggtgcttgaggataatgaaactccaagaacacatacttgggtgaaacttggcttggaatttcactaaatttgactctaaattacattggaataataaaaagaacaaaagctgagaaagaatattttgacttgaatatctgtttcatagactaagtatattagtttgcttgagctgccataacagaataccaaactggatggcttaaagcacagaaatttatttccttacagttatggaggctagaagtgcaagatcaaggtgctggaagggttagtttctagtaaggcctttccccttggcttttagatggcttccttctcagctcccatcttgtgtggttacacgatcttttctctatgtacacaccctcctggtgcctccttgtcttcttatgaggacatcggtcctattggatgaggattacactcatatgaccttatttaaccttaattatttccttaaaggcctctctctcaaatacagtcatattgggggttaaagcattaacatactaatttttaggaacccacaatgcaatctatacatctagaaaactaagtctttatttaaaaaaatctgacatgcatttgaatgatgattaatgtgctaatgcattttcatttatattaattatgtatggtcagattttgtgtatgtatttactgaagaaaatctcaatgaaaatgtttccaaagaggttacttctgcaaataaaaagaccattttacatcagctagctagtagcagacagctgtcacaggacttcctaccacaaactgatcttggagaaaaattagaagcaatatatgagtttttcctttccacgcttgaatgacagttttattatgtgactcagcttcagtcaataagctgtggttcactgcgatatcactgacttgcttgtctctttttttcttggctttataatttcagagtatgacaactactgctcatattctcagtgcaatcaaacttggcattttacaaaggccaaggagtttaaaaaatatcatgctttaatgtagaatttggaaggtaatattgaaaatgaaaaaatcagaatgctattccaatgctatatataagatggttctatgaaaaatataattataaatcccataaagtttttgataaattatgattgcatggaaagaaagtaaaataatgtaaaataaaatacataaaatattatccatgttttaattttactttatgtctgataacttaatcttcattaccaaatgactttcattatttaacaaatacttattgagtacccattatgtgccagattcattctagataccggatctaacaaaaatagtaacgaaaacaaaggactggacttcatgaaacttacattttgtatttttaatagtgattgactaaattatgatttgtaacatagaaagatacaattaaattctaggacctgtgattttacacaaatcactttaagtgattttacacaaatcactttaagtgattttacacaaataaattatgacatagaagcagacaaacagaaatgacttgacaactgtttagccactgtataatcgtgcatctctgctaattattaatataattttgtgtttctataagcatatatgttatgtatattatacatgctatacatatatacaaattaactttaaactcagaatttagaattgaatgaatccataatgataacttacttcaacttttatgaagtacaaattgtctgtcattcctagaaataggtcattcctagaaataggtcattcactattcctaaaatagtctttgacacacaattaattcataatcttttggggaaaaatgtttaaaagttgattttaaaacattataaacagatttttcattataaaataaaataatgcccaaaatttaaaagcttatataaaaaaaatttgtgagctaatgaattttataagtaaaaatgtcatctatattccttccagagaaaattaagattctttttgtatatgataatagattttgcatgtagatacacatacataaatatttttgtaaaaatttatgctcatgtattttagattgttttccattacaaataattatgaaatttgatccatcaaatgtataactacataaatattttgaatgacttatgatttaatttttctaacataacatattaattaaccaaggtcctttaaaaagaagtttcatataataatcaatgtttatatggtcactctttgtgcatacctttttatactttggctaataatttctttcattagttcttggaagagaaaatactaaaactaaaatattatcaagatatttttagaaatacagtagttttaaaactataggtattgtattagaatatattttttcatatcctgaagtatacagaaatttcacaattttaattgataattagatacaaatacttcattgagatttgcaattttctctgtaatagaaattaaaatgatctttgatgtttttctttttaacttgacacatcacttatttgatatatcacatatcttatattctcatgattaatctgaccttccttttgcactagaaaccacttttgattactttgtgttgctttacaaaacatttttaaatatggtagggcaaatttctattacattttcagtataactacctatttctcctttgaaagttactttacaaatattgaaattctaggaaattatttttgagattataataaatttatatatttgcagagaattgccatctgcataaaactaaatcttactgaaaactctatatgcatctcaagtacttttttatcaaaggcatattgaaggagaaatgagaatagaattaatctgtggtggtcctttggcaaggagataataatttgggagcaaggtttttggtacaaaagacttactttgacagagaagattaaagaacatcatgatgtcagcagagactgtaaatacacaaggctcttccttgtgctatttagcaaatctcttttttgtgtatgttcaaggaaataggtaatgcaattaaacatatttcaggattactctcttaatggcatggcttcatacagacttggcaactaaggtaggaattcccaaatgtatagttacaacaagtacatttaactgaaaatctaaaatgatattccagattttaacctgtaattcaaagttctcaaatatcagaacatgggcctgcatgtctagaaacaattcattctaagaaatcagagagtaaaccaaatttacctgaaggaaaacagcccaaggtgaaaataggcaacaatttcaacagtaacattatacatatccaaactgccattcattagtcattaaagaaatgtaaatttatttatttgcatatgttgaattacatgatccatcacataaatagaaccaatgacaaaaaccacatgattatctcaatagatgcagaaaagccttcgacaaaattcaacagcccttcatgctaaaaactctcaataaactaggtattgatggaacgtatctcaaaataataagagctatttaaaacaaacccacagccaatatcacactgaatgggcaaaaactggaagcattccctctgaaaactagcacaagacaaggatgccctctctcactactcctattcaacatagtgttggaagttctggctagggcaatcaaacaagagaaagaaataaagggtattcaattaggaaaagaggaaataaaattgtctctgtttgcagatgacatgattgtatatttagaaaatcccatcatctgagcccaaaatctccttaagttaataagcaacttcagcaaagtctcaggatacaaattaatgtgcaaaaatcacaagcattcctatacacaaataatagacaaccagagccaaatcatgagtgaactcacattcacaattaatacaaagggaataaaatacctaggaatccaacttacaagggatgtgaaggacctcctcaaggagaattacaaagcactgctcaatgaaataaaaaagtacacaaatggaagaacattccatgctcatggataggaagaatcgtgaaaaaggtcatattgcccaaggtaatttatagattaaatgctatctccatcaagataccactgactttcttcacagaattgtaaaaaactactttaaacttcatttggaaccaaaaaagaacctgcatagccaagacaattctaagcaaaaagaacaaagctggaggcatcacgccacctgactttaaactatactaccagactacagttaccaaaacagcatggtactggtaccaaaacagatatatagaccaatggaacagaacagaggcctcagaaataacaccacacatctacaaccatctgatctttgacaaacctgacaaaagcaagcaatggggaaaggattccctatttaataagtggtgctaggaaaactggctagccatacatagagagctgaaactggatcccttccttacactgtatacaaaaattaattcaagatggattaaagacttaaatgtaaaacctaacaccataaaaaccctagaagaaaacctaggcgataccattcaggacataggcatgggcaaagacttcatgactaaaacaccaaaagcaatggcaacaaaagccaaaataaacaaatgggatctaattaaactaaagagcttctgcacagcaaaagaaactatcatcagaatgaacaggcaacctacagaatgggagaaaatttttgcaatctacccatctgacaaatgactaatatccagaatctacaaagaacttaaacaaatttacaatttaaaaaaaaacatcaaaaagtgggcaaaggatatgaacagacacttctgaaaagaagatatttatgcagccaacagacacatgaaaaaatggtcatcatcactggtcatcagagaaatgcaaatcaaaaccacagtgagataccatctcatgccagtaagaatggcgatcattaaaaagtcacgaaattttttacactgttggttggagtgtaaattagttcaaccattgtggaagacagtgtggcaatttctcaaggatctagaactagaaataccatttgactcagtgatcccattactgggtatatacccaaaggattgtaaatcatgctactataaagacacatgcacacgtatatttattgtggggcactattcacaatagcgaagacttggaaccaaaccaaatgtccataaatgatagactggattaagaaaatgtggcatatatacaccaaggaatactatgcagccataaaaaaggatgagttcatgtcctttgtagggacatggatgaagctggaaaccatcattctaagcaaactatcacaaggacagaaaagcgaacacctcatgttctcactcataggtgggagttgaacagcaagaacacatgtacacagggcagggaacatcacacactggggcctgtcgggagctggggggctgggggagggatagcattaggagaaatacctaatgtaaatgacaagttgatggctgcagcaaaccaacatagcacatgtatacctatgtagcaaacctgcacattgtgcacatttaccctagaacttaaagtataataataaaaaagagaaatgtaaattaaattaaaaacacaggttccaggccgggtgtggtggctcatgcctgtaatcctagcactttgggaggccgaggcaggcggatcacgaggtcaggagatggagaccatcctggctagcatggtgaaaccccgtctcttctaaaaatataaaaaattagcctggcatggtggcggcgggtgcctgtagtcccagctactcgggaggctgagaccacctaggaaaaagcaggggggatgtaaaagctttgggaatgatttgtctgtcccagtggcacttcatgaaatgaatcttactgtttcatcatatctcctttgccatttatgagatgaagaaatataagaatataacacattaatttctactatatattcccataaaaaagctcaaaagcaggacattgaattggcccaaagagctctacccataacatgagctcacattaacttccctacctcagtatggaccttcagcaaaccccaacagttgaatccaaatgaaaccagtccccataagggtggatacgatagtgtctgcatttctgtaaccagtggagtaataaaagtttgagtctctgccctccttcaagttcccagcatatttagacagatgcctatgttcctcagttccctttgacacaggcagacctcagctccactgctaatggcctttcgccttaaagcagctggatacaaggtagaaacactgaaaacaaccagggaccatcttaggagagagggacttcatgccaataagcaaggtgcaaaggtgcaattactttcagttttgagaggaaaagctcaagaaaaataacttcctttttttttttggtctacactttgtgctatattctcattgctgaaaccattaatttatatttctgtttcttgaattggttgataattgctttgtaaaaatttatcaaatgtattattttattgtttgttgaacatctctattagccagaaaagtttacacacacacaaaaacctgttgatatttattaagctgtacatcttccatttgcctcattcttctgtgtgctctgtcttcctctgtgtcccagaaggctgaactgtaaaggctgaatcagtgtattctttattctctagcttctagctaaattcagtcagagataagcagtgctagaagatccatagagaagaagagaaataagagagtaagatcagtatgtttaatacatagctccctccgtgtaaggtgggctgtgtccatcactgaagatcaaatcttctgttatgtgagcctttcaatctaatccctttatcttgtgggttttagccctggattacttccctacatcatgtggttttcctaaactctagacaattctttctcaagagttctttataaaatctctcttcaaactatccaatttgggagtgttatgtagttcccgctatgacacaaaaatgcttatactcttcctatgggcaaggcatattttattcatctatatgcatgatttttaatagccactgtaaaactttgaaggaagtatgtttcatattggagaaattttggcctagagaggttaagtaatttctccaaggtggaagagctggaactcaatgttagaattaactccatagcctgtttttcctacctagtaagtgataataacaatgaaattttgtccctatcagtaacaaaaactatgtcattaccattatattttgactttttaactttataattactctgaaatacattaatgataaactataaaaaacaattaataaatattccaaataaaacataaaaaaattgttaagctttacaaaccctagactatacttgagatctttgccttttatactcagaaaacccataaaattatattcattcttaaatcagaatagtttatcatctgaaaaaaagaactttaaatttcattttccttatttgctgaagcatccagctgatttactatgatgtgaaactttaagaggcaagtagcatcatggcagaactatgaagtgtggaaaatggaatgcaaatgctaaaatatttagctttagatataaatcactttgtatatagctgatcatactgtttttgctaagcccttttaaatatcatgtttatatccacgtatttttattttaagcatgcatactttccgcaagcaatagtgtttatactgctatctaatttctggttattatagttgttttgaattctgacacaaaatactgacctctgaagctcttttttattaaagatgccttgaaacttgtttcttcctattatattaaattaagattttccttcttcaaatatcacactactgtgtatgcctggcagtaaagattttattctatgctcaaaggattcacaacttcaaaaaaaaacaaaaccaaacaaacaaaactgagcatcaaatatgtgaagcataagaaaggagaatttagttcagttatttaatgactctttcctgccaacataggaagcattgaggatctcataggatttgattgttccatttgttcattcaataatttaatttgccttcctaaactagaatgggaaaaaccgagcagctaaacaataatgatttttctagataccaagtcacacataaaaataaattgtttcaaaatacaaatttgattatgttaccttaattttaaaaatgggttgcctatgccctcaagataaaaataaaaaataatatgatatagtttggatatgtgatctctaaatctcaagttgaattgtaatcccctgtgctggaggtccgcctggtgggagatgattgcatcatgaaggtggatttctcgtgaatgatttcgcactattcccttggtgctgtctccagatagtgagttcctgtgagagctggttgactgaaagcatgtaacacttccaccctcaatctctctctaactccttcttttgccatgtaacgtgcctgcttccactttgccttccaccatgagtaaaagtacttgagatctccccagaattagatggcgccatgcttcctgaatagcttgcaaaactgagccagttaaacctcttctcttataaattactcagtctcaggtatttctttatagtaatgcaagaatggcctaatacacagtttttccaaaacagataatgactgtgtcctggccccccattgtgttctttcagctgcactgttttgcagtaattcttcctgattcagggtctttgcatctattttttcctgcactggaatactttctacctgttcaattaaattttatgtttttctgatttcaacttaagctttcccttccaataacagtttagattacaatcttttgttctaagttcccatgaaactatgttttatatttttacaacacacatctcagtttgtatttatagattcattggtataaaatttttggtttaatgttaatttccctatctagcatgtaagctccttgggaaggggtactatgtccatttttccctagccttttaatctccgtatacactagactgatcttgcaaataccctaaatgagctatgttgatggttcacagttcaaactgagagaattggctgataccacattcttcacctcaaactcaggtctaaaaatcccactaccctgaaccttgaccttgctaatcaattttttttttaaatagagagggtgataggagaagctgctcataagataaattaaaaccttgatgtgcattattatttccttactctggggtgttatgagaaatgctctaaaacaatatttttatacttttaaaatgccaatatgctctgggaatgattcagagaacaaacacttgaagggtaagtaaagaagcatccgctatttcttagttgcaggttaaatacatggagttcacaagagacttctgggtccaatatgaaagaacaattccataagaaatctgattttcatttttatctgtgcaccaaacactacaacacttactgggtgtaggaaagcaaatcagaaagacatgttatattacataacatgttatgttacagcaggaacaggagaatacagatgcagtagttgatttcttatgaaaatgtatggggtcaggaaaagctttacaggtggtatgatattttgcggatgattgggagatagccatggggatgggggtggggccaatagaagtgtcagtaaatgtattccaggtaaagcgattagtatatgtctcatttaaatctgagcctgacagattaaaaggcctggaaaaagtcaagtatgtcaggagcaaaaagtgcaagatagaatggcctgagctgatgctaggagaattagtactgaaagtctcttataagggattctcttaagttatggtatgagcttgtattatattccaaggcctatgaaaaagcactgattcattttaagcaagaatgtaacatgatcagttcttattaaatatttcactccagctgctttgtgaagaatgggttagaatgatcaagattgttgctgcttcagtacctgtgaaaagatgcttatgtacttcacagagatggtggcgatgaggccagatggggatgagcatgtgcagcacatattttgggagtagaaaagacaaaacttaggggcttattggatgttgatgagtctttcttaaacttttttatagcacaaactgagaaagtttaatttctgtatagcagctacccaaatatggctggtgagtagtcaaaggtatacagtatcatgctactgaatacccttcttggatggtactggcaggggtaagttgttgaagagaaaactactttgtggaagaagtatagttctctttccctgcttcaagaaaaagagaggtttgggaaagttatgtgatatagtttggatgtatatccccgcccaaatctcatattaaaatgtaatctccaatgttggaggtggggtccggtgggaggtgattggatcagggtggcagatttcttatgaatggtttggcattcctaagaaatgaatgccagatgaaggcatcccctgtggtgccgtccccaagcgagtcattgagttcccatgatatctgattgtttacaagcatatgtaacacctcctccctcactctcttgctcttacttttaccatgtgatgtacttgttccccttttcctttctgccatgattggaagcttccttaggcctccctagaagcagaagctgctatgcttcctgtacaacctgcagaaccgtgactcaattaaacctcttttcttacaaattacttatttcaggtatttttttaaagcaatgtgagaatggactaatacattttgaatcattatgaaagtttgtagaacatctagatatagcaaaaaattatatgtacttattgttattgagtcagatagttactatttgaaagaccggtgaaaaaggtaaactttctagccaaattgactctttgctattgaacttctttctctctagtactctttctactcttggtgacatttgtagtcggtgatgttatttattctctgaaatattcattgtgttcagctaaagctgctgctttttgcctttgtttgggttttatctttgcacactgtgtgccctattttcattttatttattgaagataaagaaaaaaacttatataactttacatttcttaacctatctgatggtcagtttctttatatctggctttgagattgttaacaaaattatttaaaataatgtacttctgtcaaattcttgactgatagactaattcttgacagcaaagactgctgttattcacaaacaaaacacatgaattccaatgtaatatataaggtaaaataatcaatgaaatagtttgaagctggtggaggaggctttggtccataagaatacacagtgtcattattgcttttatattttactcaaactttgtaagaataatatactattttcatcattctatagttgaaaaatccaagtcacggattattaagtaaattgtccactgtcggccgggcttagtggctcgcaccttaatcccagcagtttgggaggccgaggttggcgatcacctgacatcgggagtttgaggccagcctgaccaaatggagaaaccccgtctctactaaaaatacaaaaaattagccaggcttgatggcgggcacctgtaatcccagctactcggaagactgaggcaggagaatggcttgaacccatgaggcggaggttgcggtgagcggagatcacgccattgcactctaaccagcctgggcaacaagagtgaaactctgtctcaaaataaataaataaataaataaataataaaataaaacaaaataaaattgcccactgtcaaaatgctagtaaatataacatcacataaactcagtctgtctgattccagagactgagtgggcaatcacttaactaatttatgtttactatatattgcagtgtgtcaaaacacattgcaaacattcttttttttttttttcctgagatagagtctcactctgtcacccaggctggagtgcagtggtgtgatcccgactcgctgaaacttccgcctcccggcttcaagcgattctcctgcctcagcctcctgagtagctaggattacaggcatgcaccaccacacccagctaatttttgtatttttagtagagagggggtttcaccatgttggccaggatgttctggatcccttggcctcgtgatccgcccaccttggcctcccaaagtgctgggattacagacgtgagccactgctccaggccgcaaacattcttaaatatgaatgtgtaacctgctgaattcaagtcaatcactgggcaactgccatagagaacccccgctaattgaagatatttggtagtataacatgaactgtgtggcaagaagtatgtcaaccaatcatgtttccaaaataccttagtttatttttgtcattgtattacacttaagtgctacctctgatatccatagacaaggtaactcagaaaattagttatgtggaaaataattagaaacttggtttaaaatagtaagaagatgtaatttgagacatcagagagctacaaaaaagcaatgtaaacttatgaggcaaggaccaaaagaaagaaaaaagcataagtggattcatcgtatatttggagtcacttatatcatatgaccaaatgcatcttccttacagatgtgcctaactaattgagaagttgagcagaaccattagaaagttcatagaactaggcaggcaatttgaagttcaggaccacctacaaaaagcgtttggtaaccaccttctcccaccacctgcaatcctgtaatctgtggcccagaaaggctagacaatagcagtaagaatgaactagaaattaattggcctttgcaaagactgaagccctaatcggattaaagtaatctggattgttactgagtctagctttctacaaaagcaaagttaatcctttgaatattaagtaacaagtaacactagtcttgtatttgctatgccctatctccacctattgtattaatttctgaacgttttagttctggagtttccatttgttgtgtttttatatattctacttatttgtcaatgttgtcaggtttgttttatatatccatgaacactttaaatttacaaaatatctcaattttctagattaactttgggcctgtttcacttctcatttgtctcttttgttttgtgattatattttcatgtttcctcatatgctctttttaatccaactctgaagagtttggtaatatttcatccaaatgctttgtataattaatcagcaaaactatctttgcctataggattctttgtgggaagattttaaactataagctattatttgttgaatgagatttggttacatgtgacttttaagcaatgtgttcattttatctaagatgctgaatttatttgtatatattattcataatgttattttattttccttttaacatctataaaatctgcagcgctgttaactctttcattactgacattggtgatttttgtctttgtcttgatgaatctggtttgcagtttatcaaatgtattgatcttttaaaataatcagcttttgatttcattgattttatcttcttattgtgctttctattttattttactcacatttatttctttctgctgcttgcgtttcattttaaacttattctaaaaatccaaggtgaaaatttaagccactggtttttgtttcccacttaatccttaagtgctataatttcccatctaagtactaatttaacttcattccttcactataagaaatgcaatgactttaatttaaataataggtcttaagaatcaaactgggaggaaaatctgttgcccacagttttgtttatacaggcattaaggtaatagcccaactcctcttgcttttccaaatgttgcccttgtcataattaccttgctggttttccttgacttaattatgattttctaattcacttgatcttgaagtttttcagtactttcttgagaaacacacacacattcacacacatacataacacacaacttatagcttggactcagttggcggtcatcactttgggataagatctgttttatctacccttttgcagatattatggactaaggcaggtttgaccatgtggaagtcttgtccttggaagagcagagatctctatcacttcatggtcagtctacttggaagacatacaagtcaggctctggtgattcttcccaaatttatcattcagtgaaagaactccaacacttttttggtagaatgagtaaaagggtaaagagaggccagcagttgcatattattgggcttgtttaaacatcaaaaagaagcatcaagaatggtgaaaaatattttttcaagatttcccagtttttttctttttcattttcttaatttacctgttgagattgaacattaagcctatgattagccagagttttggctctctgtggcataggaggcaatttgttctgctctcacattccttaatccacactgccaaaaccagtaagttcttctgtattttagtgggattctgtcaattcaattagaatttgcctggaaaaaaactctcaagtgcatctgaatagaatatttattctattaatcaaaaagtatttcatttcaaacctgaaacatcattttcttttgtatttttcaactcatgttctgccacataatgcaatctgcttattgaaggttaaacaataatattaaatgatattataacttttttaacatcatataattgttaaacaaaaaaaatctaggaaaattgcataatgacacattagtaacataataacaacagctaaaagatgccacaaaatcctaaggtgaaatcaaagcttcagaagcaaatctttgcaagttaaaatctcagtatcaaagaaagtaaattcttaaatcaaaacttctcctttatgagttacaaacattgacctctcttgctactatctccttattcctcagtttcatttgtaaaagttctgagtttcaatcccaatttgagcctggattgcaatgaactaggacttctatgggtgtcactgttctttccagatagctagctttgcatgaactaaatgtcaaatttcgaatggctggatctctactctaaaggctccaaataaacatcaaaacatatgcaatatcaaagcactgaaaacccgcaatagccaactttaaaaaataggtacatctcaacccttagaatttctatccagtaaagttctatttcaagaacatcataatgttaccaaagactattacaaaaactcaaaggttactaagtgctaatagaaaatcttctgtgcttagcttcactggagtgtcaacacttaatactagttatgtagaattacaactttatatttattacagtaaatacacaggcatgtaaggaaaaattctagaacagtttttcttagtatggtaaaaattttaatcaccatttcacttttgaagatcattctctcttgcacagagcactaaattcagtacgagatctgctatgatgtttctctcttatatgtaagtacctaacagaaacatcatgcacgggagagggaagtggtgggtgggtagttactcgagtcatgttgacgaaccacatggattcaaggttgtgttattccctccactattccccagtatgctctgatggctactgaaatcaacatttcaaaaaaaaaagcacataattagggacaccctaataatactacaatgtggagtgccaccccatatttcaagttagcaccttatacctcacatatctgtgctctgtagtagttatgatagttagatatatgatttatctacttaaagacttttctggcagacctagctgagaagaacagcaatagtaacaaatattcaccctgataaagtccaaaacttccggacacaataagtctctctgtttcctccatttgaatcttgtccttgatacccctccttactgcgaccttttaacctacgtatttgtcaagggatgaagccttgaaagttaaacatcaatcggcattaccccatacaatttgcatcacccgatatgtggcaaaggactaaaacatttaaagtctttactctgtgcaagattttttttaacccaggctctattgatttccccagtttttactatttgtttatttctcatagtttgaaggctaatcatctagatgttggggattttgatgttaatcccaataaaaactacagccttcctactttgctctaagggtcagagcatgctgctgtaaaatttactgcttggaggaaagcagtggagattccacgccttttcctgatcagcctgcttccaaaggagggagaaagtgctggcccttcagggaatctggcccacggttggccaaccacagttgggaaagcctacctctgaaggaggaatgttttatgaagaaaagaaatagaggaaactgaacccactaaggctttttccgccttaagtttacttatcagagaagtcaatttcctctgtgttgagaaagtgaagacgccatgagatgctagaaatactgtacctgctgagcttccataacatgtaaggtcaaccaggcagagataaaatgtgttccctctaatagtagcaatgttctttcagttgaaagctttggaagccaagaactacatcagaaatcttaagttacagaaaaataacttacatagatcttctcctgaaatattaaaacttgcagaaacatttagtggaaataagtgcctgtacatgacctgtacatgaactttagtgcaagatactggaatatcttggtctacaacccaataggcatctcttctcatttaaaattatttccacttcatcatgctgacttgttttatttcaacagaagttagctactagtgagattacaaaatgtctaatttggtggagtgttttattctaaagcgtggtgtagtcaaagtgaacagcatcccccaaattatccaacccattgtaaactttcaaattgagcctatttatacaataaaaaactaccttcaagtatttttacaaatgagtaaaactaaacatcaaccaattaccaaatgatggaaataaataacatataagaaatatcaaacatagctttaataaagaactgggagggaagctagagaaattgagctatcacattttaatctcttattttagttgatctatattaccacagaaaaatgtagaatgtaaatatattaagatataaatattaaaaggttcaagtttttaaatgtgtatttatataaatattttgtataattatgagattttctttcttcatagaaataagatggcatttcatgaaaatgataagcattttcaggaaacttcaaaattgtcagaaggattttaaataagaacttcataaaaattgtggggaaatcagaaaaaaaacaaaataaatggggaaagacccgcaagcatagtttagcaaattataaaataaacaaagatttgaaacagtcggtttgatattgtcagcctggtgaatttgcctctttcctatatgcctttaccgagcaacagaatgagggactgtgtgttcccttcgaatcattcttccagaacaaagctgtacagatttctgtcccgctagctgccttcctcaacttacattctttgacgaaagtagcccatggttttaaagtaccttatgaaactgagaggtgacagtgtgctgggcagcccttgcagccctcgctcgctcgctcttggcgcctcctcggcctcggcgtccgctctggccatgttcggggaaccctttagcccaccactgcgctgtgggggcccctctctgtgctggttgaggccggagctggctccctcagcttgctgggaagtgtggagggagaggcgcgggcgggaaccggggctgcgcgcggtgctgtcggcccagctagagttccgagtgggcgtgggcttggccgcccggcactcgcagcaccggctggccccgggcagtgaggggcttaccacccgggccagcagctgcggagggtgcaccgggtcccccagcaatgccagccgactggcgctgtgctggaattctcgccgggcctcagctgcctccctgcggggatggactcgggacccgcagccagccatgcctgaccctcccacgccacccagggctcctgcgcatcccgagcctcccggacgagcgccgccccctgctccatggcgctcggtcccatcgactgcccaagggctgaggagtgccggcgcatggcgggggcctggcaggcagctccacttgaggccgcgcgcacggcctgtggctggcaggcagctccacttgaggccccaggtgcgtgcgggatccactgggtgaagccagctgggctcctgagtgtagtggggatttggagaatctttatgtctagctaagggattgtgaatgcaccaatcggcactctgtatgtagctcaaggtttgtaaatgcaccaatcagcactctgtgtctaactaacctggtggggacttagagactctttatgtctaattaagggattgtgaatgcaccaatcagcactctgtattctagttcaaggtttgtaaatgcaccaatcagcactctctctagctcagggtttgtagatacaccaatcgacactctgtatctagctgatctaatggggacttggagaacttttgtgtctagctcagggattgtaaatgcaccaatcagcaccctgtcaaaacaggccaatcagctctctgtaaaacagaccaatcggctctctgtaaaatggacgaatcagcaggatggggtggggccagataagagaataaaagcaggctgcctgagccagcagtagcaaccgtctggtgtcccagcattgtttctttgctctttgcaataaatcttgctggtgctcactctgggttcacattgcttttatgagctgtaacactcactgccaaggtttgcagcttcactcttgagccagggagactgcgaacccactagaaagaagaaattctgcacacatctgaacagcagaaagaacaaactccaaacagaccgcctttaagaactgtaacacttactgtgagggtctgtggcttcattcttgaagtcagtgagaccaagcacccaccaattccggacacgaaatgaacggatggttttaagcagtgcacatggcaggcaagaataaaaacgaaacgtttaaagctcgtgtgaagctgggtttgcagtatgactaagttgtattcaaacgggaatgtgtaagtgtcccatgctgcttttaggaagtgtctttaaagagagaaaatataaaagggattgtggaaagtttatatttgaggcatagcttttgaatgtgttgaaatgcaagtgtaaaagcagaagaacacaaattggataacgaaagtatgtatccaataaaagaaaaaaattatgaggtaaagtttcctcaaacaggaagtcatgatcacgaaccacccatgcttacaagacttttacggtgccagttacctcaggatttcaaggcatagcatttgtgcaggaagactctgaagtaaggaatatggagtccgtccagtttgagaactgagaaaagcaaacaagggttcaatcaaaaactcagcaaggaaaattgaggatagcagccgaaacaggcaattattcggcagtaggcgatgtcaatagataatagtaatatctaaagaggttaaagctcttgaccaatctaaaactaaatctgtagttttatgactaaaagaattcttaaaatcaacaaaagctcaattccagagtaatcctcgtgatgaaaacaacttctgggagtagaatttaacctaagcaggatgagggcaagagagacaaagaaataaaaggtgcagatacaactgggagaaagaaacagagccatggactatctgagaatgagatgtcgtattttgtttctcttcattttgaacgataatttaactggggatataaaattctaggttgatagtttgttttcccaacacttcacgtatttaatttccctttcttcttgcttgcacagtttctgactgaagttttctgtaattatctttgttccactctaggtaaggtgcttcctctatctctctctactcagtttcaagattttctttttctctttgtgtttttatattttgaatatgtttagatttttgttttgtttgtttttggcttttggtattacttggtgttctctgagtgctgttaatctgtattttttgtctttttggtgtttcaattgcacttatgttataccttatgtcctgttcttgctttccttttattattatttttatttttgcatttaaatttggaaagtttctgttgacccatcttcaagctcactgagtatttgtgcccattgtgtcaaattttctgatgtgcctttcaatggcattatttattgcctttactgttttgatttctagtattttcttttggttctttctttgattttaaactgtctgcttacattacccatttgttcttgtgtgtatctacttattccgttagagtccctaggattaatcacagttattttacattctgtattagataatttcagtatctgtttcatatctgagtctacttctgatgcttgcttttctcttcagattgtttttttcttacctgcggtcataccttgacattttttgttgaatgccagatatgctgtattgggtaaaagaaactgtggtaaacagacctttagtctgaggatttttgttaatctgggagttggactgtgcttaatgtatgttgtagctacatttaggtgctagaggctttaaattcctgtagtgttcttggttttgtctcccctcttgactttgggcttcccttcttactcctccttagagagaggtaccgtgtagcctggttgttgtggtagtaaattgtgagagaagaggagaattctgtaatctttccattaaatctcagttgtatagcggagcctatgtctcagggatgttaccttgacaagtatttctccagtggtatagctggttctttgttgttgttgttgttgattttttttttttcttacctgctactgtctatgctggttgaaacagcctttctctatgttttgaagctttgacacccgataactattttgttatttttgttggtaatttttctttcagatgagtcaggaaggctgaagagagctgggatgaggaggatttcccctatcaacagataaggctctggcaaagtcctttatcctccagcataggatatttttatagaggattatatagaggctcatcacgatggtgactctttctctccctaaaccagaggcaggagagtgtgtttcttggctcctcatcataagaactgaggtgtttctgggagagaagactcatgaaaagttgcccccacacccatagctcctaggagtttctgcagctcccaggagcttctcactctcatgctagttctcagtcatcttggatacattcatcaaaaaaattggtattcaaatcttatttaaatcttcttgtatttttatggctgtagtggcttctgccctgggtaagcagattttaggaggtacctgtctctccagattttagattggcagtttaccttgtgaactcaattctctgatgggtctaagaaaagtcacggatttttagtttgttcaaatttttcttgtaacaaaatctggagtgtatggaggaatggagtccaagcaattttcatattaaacatgtaagcagaagtcaccaccatatttttgaactttacaaaaacagcagaagcccttcagtttccaacaaaacaaaacaaaaactaacctaatgcagccctcatgcagaaaagctttgctgttcaaaaacagcaaagaaacaaaaatatcaagttcaagtcttgtataaagttctccaagagaaaatcatattataataatagcaattctatagacaacaaaatctttccggaaagatgtaaccataaacagataaaaatcatgatctaatatttcaaaataaagtttaacatgttaagaaaatatcacaaaatgagcacaaaagaaacaattaaaatgtggtattgaataacaggaaacagaaaggaaagaaaaatatttcagagctaaagataaaacttaaaggaacatatgaacaaaacaaaacaaaacactataaaaaatccaggattaaaaaaggaagaaaataaattcatcgtctattttaatacataaattaatttctccatcattttgttgtaattgttaaacttttatatagcagattcaaaagtgacaaagagatgacagagaaatttctatacatgtatatagttatatacacatatatataaggtaatcaaaggtaaggatttaaaacagtctcactgactttcaagtataatgactaaagtatacaatttcatcgctatgcaggcaataaggaaatattgtgtctggtaacttgtctttagtaatctaaatgttttcataccggacatcagataatcaaaataactggaaagacattaacataaagactgttagtaaacgtcgaatgtataaatttacacatacaactaacagtgaatgagatgtataaggaagaatgtatagtttgtaatagttagctgctctgtcaatataggtaaagtgcaatgtgaaaaactgaagtgagactagcaagagcttttgtcagcaatcaaattattggtgttgaaggtattgttatctgataatgtttccatgtagtataaattaaaatatgattatttatgttgtactctaattctcttcacaatgttcttaaaaaacaacactccgtttggtataaaaaagattcagattcaagattgtagaaattgaagaaacactctgtagcaatgaattttaaagaggcacaaagtttgaactaagatttgacactaaatgcttagaaattataacaattcaatagaaattgatcaaatgaagcctgatactgatttgaaatcccactttctactaaagagaatcagggtttcttgagaaaatggctgattataggaaagatcaaggaatgtataagattacttgagttattttgggattgtacatagaaaggtagctctcatgtaacactcggggaaagtcatccaaattttggaatcaactatgagtttcacactggccaaagaacataaaatataaacatcaaaatctaatacctaaattagatacaaaaatgtcaaataatgtgcattacaggaagacagtaagggactttaaactcttcctacttaaattattttaaaaactactttaattcattcgttaatattggttctcacgcacccccagaagttatactgacttggtcacgttatattatgctagtagccatttttttaactagtaaataaaataagactatttagcatttctcttgcgtttcctgttcaaatttacgtctggataaccagatagtagataagatacagtttctctttacagaagtattccagaaaataaattaagcaaaaatagtgaaattgtgtcatcattttacaatttctattaaattaatggagctatacatcaagcatcaacagctgttaacgtcacaaacatagacaacaaaccctggtgtgcttcctaaagaacgcatcctcaccttgtcaaccttggcaaatcatcattcttgaatgagacttagtctctagattcaactaaaaatttacatataactcagaggacaaatgaacgtgttaaactatacaaggaaattaagtcagtaagactatgactgtgaaaaactcacaagacaccatctaggttcttcaatacgtacattgcaagccaaaaaaataaaaatgagaaagagagagggattttatagattaaaagaaactgatattacatgtaacaggcaaaagtaaattacaaggagtttagcagtatgcatttaagtgaaaaacctataaggaaaaataaagatgttttacaatagaagtcagttgtgatcacccttggaaaggaagaaaaggattgtgattttgaggtagtaaatggagggcttttgtggtatgtggcaaaattatatctttaaatgggtaatattttaaatgccttgtggcatttcattactggtttacatatttcatgcaactttctatatttgcatcatcttaattaaaaacatgttaaaaaggagataattttcttcatctatcttccttcatgttggctgtctataaagagatgtgtctgtgacttaaatagctatatgaaaccaccaggtgttataccaagcttagaaaaatagcaagatatctgcatcccttatctgcctatgttatgactccttgaggacagacagaattacatttataccttgttaaaccactgttgttattctatatttttctaatccttgaaagcaaatataattctgactaatacaaactctcggatgaaattaaataattgaggaaagattctggtagtttttaaaataatttaagtaggaagagtttaaagtcccttactgtcttcctgtaatgcacacatatgggtaagttaagcaataaaggtgacaactgaacatgatagatctctcatcagtgttttagtagaaaggtcattagaaatacacaaagaaagtatacattgtgatcagtagaataggaggataggaagataacactgtatatcagctgaaaatacattatttaaaatgcatgtccttgagaagagaaacatggtaaagggccttttgctctagagataagaaaagatacgcagcaatgattatgttctggacatgtactaacattcagaaaatttacatgatcagagattactaaataaacaaataaatataacaatttagtagagctaggaagatctcaaaatatgttcaatcctaaagtcaatgcaatcctaattggtaccaatgagaagaggaaatcaatatagttactgcatcaaattctccaataagctttttttctaaatgtttacaggagattaaaaagaatctcaccaccatgaacaaacaaacaagaattgagcagccatgcaaaaagagggccaggcagctaaaataagtatatagtttactgaggcttacaaaatatcatgcacggaaatatttttaagaataataatagcaagcagagaggctgagaggaacctttaagaggtgatggatatgtgtatggtattgattgtgttgatttcatgggtgtatacttatgtctgaattcatcaggttgttatatcaaatatgtgcagcttttttatgtcagtcacatctcaataaggtgttttttaaaaaagaagttcacaagttaataagaaaaagtattctccactaggagaaaaatatatagtaagagaggaatcagcaagtaatctaatcaagtcatatattacataatgtataataatataataaaatattaagcatttattatattttttctctatgaaagacaatgatttttaaaccaggaattatgtgcaatcattactataaaaacactgaatccaaagggcagtaatgtgacaaagtatgctaaatatatatgtcttttctggagccaacaatatttcattttatggcaaccaaattacttgtatcgtgttcccctgtctctaatatgggcttacctcagaagactaattataggcaaagggaaagcaggggataaaaataaaagagctgaggacgacatcaacaaaatgtagatattagtaagagagcactaaagaaaactgagaagtaaaattatccctcttcagcatatgggatacagaatcaattccaatgagtcgggggtcagcatctgagaaaggacagtagcaagaaattagagacagggaagcaaattttcatgaagaaggtggtaattcacactatcaaattctcaagagtgctcaaatagaataagagctaaaataagtatttgattctgtaatgagatgttttatataaaataaagcaccaaacagtagaggccaaatccagtctatggtagattgttttaataaccaaagagagattaatgtggttttcaatctcaaataattttctcagtaaatggaaagagcgatgtgtgtaaacatgaaagaagttctaattgtttgtgtctgtctgtgtgtaaagatgtgaccatctttggagatcgagggtttcagcaaaagggcagatttacatttacacagccttgaagaaaatatggtctcaatgtttttatatgacaaatctattctctgtttattggtttattgttttaataagcacttcagatagctttttatattttggttattactttaggtgctcaggatataacaaaagaggatagcagcctgcaatttcaatgtggaatgggatacttttgtttctaggtaatatggaaaagcaggtaccatatttatttatcctccagcttataaaaaagaactgaacaaaatttatgaaacaacagtctgccaaaacttagaaaacaatgcaggacaagatatgatatctctaaacgaatttgtctacatgctcaattggaagaaagagactccatgaactacaaaaacctaaagaaaatggtgcatgtggaaaatttacaaactcaactcatttttcttgtgtccctgcctctccttccctgtctcttcctcctcctcccatctttgctctggtcctgtggtgtttctatctttctggggagccaagattcagtgtaggaataaagtttatgattttaaaaatctggatttaagaggttttgctcatatgaacttaaagtttagctctcacttataagtgagaacatgcagtatttggttttctgctcatgcattagtttgtttaacatagtggcctccagctccatctatgttgctgcaaaggagatgatttcattctttttattggctgcatagtattccattgtgtttatgtaccacagtttttcaaatccagtctaccattgaggggcatttagattgattccaagtctttgctcttgtggatactactaccatgaacatatatgtgcatgtgtctttatggtagaaggtatataatcctttgattatatacccaataatgggattgctgggttgaatggtaattctgttctgagttatttgagaaatcaccagactgctttgtgcaatggctgaactaatttacattcccaccagcagtgtatgtgtgttaccttttctccataatgtcaccagcatctgttattttttgactttttaataatagccattctggaaatgaacaatagaaaaaggggcttacttgagactggagggtgggaggaaggtgaggatcaaaaaatctacctattgggtactatgcttattacctaggtggtaaaataatctatacacaaaatccctgggacatgcaatttacctgtataacaaatgtgcatatgtaccctctgaacctaaaataaaaggttaaaataaaagctaacaaaaataaaaggttctgctgctttactgtacctgctttgctgagctcttttacagtgagaaaaaaattatctaaaactaaaacaacagggaaccagacaatcaaactttggtccgcactctggcaagcatctccctagatgggagggctttactaaaggggacaacatagaaatgaccagaatgggaatttcaaacattaaggcagtccaggtttgctgggactccaactggctaattattatgccctgttctagggcgcattttaaaccgtatggccaaattacattaaggaaaattcagagcccaaatagttattatgaaaaaaaggaaagaaggaaataaagagaaagaaagaaagaaagaaagaaggaaagaaagaaagaccctacaacaaaagagtctaaattatttcacatatctatattttttcttcccattttgaatctgctgacttttctactagtgttgagataaaactgactttttatgatattagtaattctaagatgcttggcaaaaggaaaaaaaaaaggtaaaagttcttttaaaatcaagctgctatacaaactgctttacccattgggtaaataaagtttagacatgtgaaaaagtttcaattttgtcaggaaagtaagcaggattcaaccatcttgtttatatatacacatgtattatgttgcatgttgcatcttcatggtgccaaattagcttataaataaaggagtactcataaattaagcaaattagcccagatgcttttcaggttcatgtgacttcagtattctcccatgtatccgtctattctcatgctgctgtgaagaaatacccgcgactgggtaatttataaaggaaagaggtttaattgactcacagttctgcagggctggggaggcctcaggaaatttacaatcatggcagaaggggaagcaaacacatccttcttcacataacagcagcaaggagaggtacaaggtgaagggggtgcgggaagccccttataaaaccatcagatctcatgagaactcactcactatcatgaaaaagcatggaggtagctgcccccatcatcaaattacctcccaacgggttcctcccatgacaaatgggtattttggaaactacaattcaagatgagatttgggtggggacacagccaaaccatatcatctggtaagtaaaaataattttaaaattattgataaaaatataaatattttcagaattgtctggtctgcattcgtgtttgtctgtgtttactggttttatgtttacatttgttagacattttaagatgtcagaatttggcgtgaaagttataaagctataaacccggtgaaaacataatgatttttatttatataatttttttataaacaagagtgatttaatattactgatttaacaaaactaataaaatcttctgtgctattggcaaaatgtccatgtaatttaaagttcttgcttgggtgaacacctaatatttacaggctataaaatggttaacaaggaaataacttaaaatataacaagctttgtctaatattttagttttcataatctatatgaattattaaaaataaactaaataaatataaataaaataaatgttattaaataaaattttaatgtatttttgaaatcttagagttatgtcaaattaaataagagatatactttaaatatctgcgtcattccaaattaagaagatttatgttatagggaaagatgttcctaaaattataaagtggttctcatgtgtaaaatactgtaaaatatgacagacaattcaagatttcttgcttcctagatttttcactaaaataaggattactaagcgttaatacagtgattgatatatgtaactaaaactactgaataaaagaaacaattacatatttgcaatgtataaggaaaatagaaatatgatttttgcttaagaaaatttgatttttgtctagtttagaggtgtttaagggttattttaaattaaagaaaattttttaaatgacagataaacctaaatgtatataaaaagttgaggaaaataaaaaaactaagttatgaaaggtttatggaaattttatcctgaggtcaaaactgattgcaattggatagatttgtatataaggtttttaaaattagctgtatcattaaaagtgccctaatacaaaactaaaaattttggttaaaataacaaggttttatcaaagtgttgatttgttctcagtgatattgcaagaaatattgacttttaattctgaaatctgtgtctttataaagcttctcagatttctgccacagaagttcgacttttctggtattttgttacctatgatttgcagatcacatcattgccttctgttccttttcccttgaaaagtacgtctttttgcttggctggaatgataactctctctttgaacattttcagtcagtacctgtaatattttcccctggttctaattctgtttttatgacataatgctaaaaagcttattttgaaagcctaaaaaaagcaatgctttcctcaaatgtagcattattttgtaatatatttttgatatgtctaaatactttcaggtaaccaagaaatttcccatgctgtcactaagaatcaggtattcctcctgctttctgctaaaggtactagttttaatgctaaaatttctctataaccttagatacattcttcttatgtctacttaaattcaggtacacttttcatcagttttaactctgggttatttaaatgggccttccataaggggaagcaatcgtaccgcagaaggtttttctttacctttttgatgactggcctaaaacaaagattttatgctttattatggcaatttatacattgtcttcattggttatttttattacttaagaaaactgagctttaaaagggttaaggttttcacaaccttgtaactttctgtattgcttttgaggtcttctgattatcatgctagttaaattagtaaccattacataaaaatgacctgtgattctgttttgattaaatgttttgaaccttttgatatctttggtaggacctaaaattatattggaaatatcatcaaaggataaatcatactggatcttcttttggttacatttataggtatgttattcatataaattctataaaaattatatacatttataaaaatataatatcctatcagtcataattttgactatattaaaccttttctaaagttatatttatatagatattaatataaatattttaaagattatgtcaaatgtatggaagtctggtggttctaatgtgatgattctggtttttatcttactgtgctacatataatagaaatagctaaattttattgccaattgaaaattttcaaccaattttaaccatggttattacaagtttctgtcacccacaattcctggagggtaggagctgccactcagtgaccatgtcaagggcacgttggctctcagccccagccactctcccatggccagcacacaaggccaccacagcctggtcctgacgtgatacccaagaccggtgggtacgaggggcatctggtgagttattgtttaaacttcttctctaaaagcatttacaataaactgtgatctaaattacttttcatggaaaggactctgacaagtactcttaaacacaagattactttggacatcataccatcagagtagaaaaaactttcaagactctaagtaaaaagctaaaataagaactgctaatctaacatcaagcagaacaagagttaattacacaggattgaactgatagaatacgaagattttattcatgacattttcatttgaaatggctgattctctttatattttgttttccagagtcaagataaccttttttctttatttttaattgacaacacattagatagaatatatttttgtggacaaaaatttgaggtatttatatttctctctacctgatttctccagaatttggaagccatttgtgagtattcttaattaatggcaatacaattatttgcataagttcaataagaatctgtttccttttgtaacaggatacaactggagacactggttattttaccaaggctttgattagaatggcatattttcagatatgatcaggctgctttgagaaattggtgctgacttcatagagccaatgaaaaacttagaaagactggactggtaccttgtctacaatgtttccttacagggtttctgtccttctgataattaaagaatatcactttctgacaggcctgggaacctcaagatattttggaaccttgagaagagagaaatacactcattcatacagattttacagccacaatctgatggattaaccatggctttactagactcaaggcttttaaaaatctaaaatttcttataaataggttccaacaaagctaattttaaaaaagaagcttataaggccaattattgctgcactttatgcaaataatcatgccaggtagatataagactaaaacttattttgcaaacaagtcagtcctatgatttgtctctgataaaaatgagaagcttgagaaagataaattatatttcaacagcaaactataacacacctgttattggattccaacactgaccattgtttttaagtttttatcatttgttataatcaagactgaatcctgaatttttcctggcttcaataagtgtccctaatgaacctgcatataatatattttaaaaacttcttgttatgatttccatcaggaataggatctatttttgaagtactacttaaactaggaattataattcaatatatgttggagtttctcttccatcttgttaagttcggtacctactatttgtttcttatttttaaaatcaaactgattatatcctacccaataccaatgacatgttctttaacctgtctttgttatgagtaaaccgaagacttttccatgtttatcagggacactatgtgaacctcctgaatatgcatttatttgtcaacatattgaccacccctggttttatgcatgtgttgacagctgatgcaagagagttaattgtttattaggttatctgactattcttctttctatttatagcttcactgcttctcaatattggaccagtttcttaaaactattttccaggaatagacaaaccctacctgcaaaccaagaagacagattttggcctatgtttagcaatattctcttgccatgatggagagtatcctctcatgaacaacgattataaatctgtcaatcaccctatgtaacttctcaaatgaagcagctaaagccatagctgcccaataaaaatctttaaactctttagccacagtagtaatggataacagaatacccctagactaagtattggtggaacaggaaagagtttctatggtagctaacatatcatgttgtgtttacatcaatacatcttctgaagttgaaacacacatgaaataagaagacaacaagctaattaatcacaacaaattcccagggaagaaccaggtgccaactagttctcagatatatttttctgaatcccacatagaattcaatgtatgcccccaagccatatgaaaattaagactttacctattactaatgctcatttttggacatttggttatcaaatgctgcctctgatgttaaacctttaaactgttaaaagagaaaccaatgtattaataatgctaaatgttaatattgtaccagatattagagaatatcttcaacttaatgcaaaatgatttcatcctttaggcccaaacctgcacccctagtcagtaggaaaaagctagaatggatgttgcccctaatccctcatgactgaagaatgcacatagaacaggggggatttaaaccatgacccaaagatttagttaaagaaaccaatggctaaaagaagttattgagtttgcaggttggcagattaaaaaaagaagaagaggaaacaacaacaacaacaacaaaacaacaacaacaacaacaaaaacttgctgaaacactgaaactccctttgcttattaactaaagaacactgactgaaattggttggactcaatatggccaactagagtctgcacagaaagagcttgctgacattgcaacctgaattttcagtgcatgtttcataacagctccctccaactttgtacatgtgatccatgcgatagaatgaagttaactgtatgcccagggactttctagaccttctctttccttccaccaattatttgatcatctcagaatccacctcctgaaactttttgtatacaaatactgctttgaagccagcatggggagaaaaacttgagtttgacatgcctgtcttcttgtgagtcaacttgcaaaataaagcttccctttcctcaaaaacctgatgtcatagtattgtcttctagcacatggggcagtgagccccgttggcttgataacacttctatcacctagaatggaaacacaggtagttcgaggggcatagagtagagaaaacagagaatcattgactaagtaatggtaccaaaagtattttcagactgaggactgttgtggcccacgtagtaaatatgaaagcactaattagtagctgaggacaataaaacagttattataactgtttttatcatgttcatgaatctagaggatatagtttgcacaaaagtcgaagtatatttttctaaaaagccaaatcaaattttcagaccttaaaactacaatgctgagaaaatataccagatgagattcatggcagataatgcataggttataaaggcatccaaaatcctaagaaatggaagtagaaactacccaaaatgaaacaaaatatgaaataacaaaataaaaaataaagcataagtgagcagtgagacagcctcaaggggcctaaaatataaataattggagtccccaaagcaaaaaagagaaataggtacattaaaataaattttgaaaatttattgctaaaaatatatcacatttgatgacagctatagcctcacagacacaagaatttcaatgaaaccgaaaacaatatacagaagaaaatgatacaaaggcacagcataataggttgctcagaaatcaatgacaaatcataaacgaggtcatagaaaaatgcacattaagtatagggaacaaagaaaattaaaactgctgacttcatatcaaggcaaatgacagtagagaaacttctctaaagtaatgaaataaaaactgtcaacctaaaattccataccattaaaaaatcctttcaaatatgaaggcaaaattatttcagacacaacctctttttgtggtactctgttatggcagccctcacaatataatagaattttctatttaaaaatgtgcattagaaataaacaaaccagctgggtaattactgctcagtgtctggcagtcgttcattatacgctcctctgggaaagaaacaggactaaaaatttttctgagatggcagggaagactgcaaggaaaaataaaggcagcaatattgttggatgaacccgatttaaataatttacagctaaaacatgaaagcacagtttttgagactctggggtattgctggatatgttctttgtgttaggctatgctatttgatttttaattaagtcttcaaaggggccgtatcagttctcaaaaatggtgggacattggatatttatccaatgtaataatacctggagagtaataatacctggattttatctcagttttattgcttggttgaactatttaactcgcagaacctggtaactcttcaaaaactattgaaagctatgaaaagaaaatacttctgcttctacaagggatttttatttaattaatttatttattactgtcatttatttatttccttgggctattagtagcttttgtttttcctatgtcagatcagtgttttctgtatctatgcttgaaaacaagaagattgggatggggcttattatagatttccttttaaaataaaaattaattcctacaatcaacatgaactacctttttgctgttatatactataaaattgttagtactttttttcatagtaatacattaatatactttgaaacaaatccaggtatttcacttcatggagaagttgactatcagctcttagacaacatcataatctcactttcaactgcataaattttccaaaactcaattcatctgtctcatgcttttcttgactgttttaaaattacttctatgtcacaaaatatgctttatgtctatgtttctgccaacttatgtttgtaaaatatttttacatagaaagaataaaagcatacacctgggttgtgattacttctccaactgcctattaattatttttaataataaatatttaggttatacatggaaagttacaatttcattcaacataacaccataaaacagaaggaattgtagcttacttagagagaaaactccaatgtaaatattactggcaaaacttcctgaaactgcagggttttgaaagaatttgaagaaaaaaagcacgtgtcaaattaggagtacatctctcctctacgaataatgattacgctagtaagcttaaggagaaaactgcaaatgcggtgtttcaaggttcagttctactgtatagatctattaagcctagttatataagacctacgtttcagaggaaattctaattccaaagcttagttttttatttccttcaatgtgaatatgaaaagtcaaggaaaaaaaatgcttacctctttcaggaaatggtcggtattactatggtctgttaatatcactgaagaatgacctttcccagataattaggttttcctgttaactgaagtctaacattttactgcaataaaggttattaaatatagcaaattctgaagtttcttctcttaataaaatacaaggaaaatcaacttaaaatacaatccacaagatcatgattttgaaaatcagattattgtgctcatgataagatagataagatagtggatgttgatgctatagggcatagtggtgaatgttatctagtctaaggagttaatctgaaatgtgacttctttgaataagaaaattatttgtaagaaattagaattttgcttattgttatcttcttcacatttgtgtaataatacagctctctgcaaaatatttaatatatggagctgaattcgagacaaaattgcttttgctcatggcaaatttctgctaggccctaatatttagtgatagtatcacatgtctttccagaatgtagtaataacttctacagctattgaggccatatagagaactcccggatgacagggatctaagaatattcaaatgattaaatatttttatttgttactattgtatagtctaggttgtcttcttaaatgtcccagcagaaagcagaatgaatggcccatctgccactaatgtactattaggactattccgtaaagaatttgggatggatggagagtggagaattgttagcttctcagtactgtggagacatttatcttctttagcctggctttgaccctttctgttttcttccctcatggttcttgttgataactgatgtctcagaactatttttctatgattttggactctcatttcttttgtgctcctgtggtttgttgctttcctttgctttttatttgtccattttcctgacatttttatcactaatatacatcagtcctttgcactcagaatgcagaagattgtcaggcttcaggtacttcaggtcttcctatacttaggtctattggggattcctagattatagcccttggctttagttaaatgagctggtaaatctttatagagctatcttactgtgtgctaacacgaggttactaacataatacagttaaagggtttccctgtatgctaacaacaagacatcataatgaatcttaaagatagtgcatacagacatatcaatatatttgttaatgcatttttcatggctgccattgcaggaagctggactggccctgactgagtgcattcaatgtcattaaagcgtaacagaattaatgaataagcagcaaatgaaagtctaaagcccaacataacaaaattggataatataaacaccataatatatttataaaagttatctatgtgggaaccaccccacatagaaaatcaatttctctctctctctccctcgggctccacttcagacttccttggctacccaaggatcacctgagtttcattattatgtatgtgactttgtttctgggcatggacttttgtacaggtaaataaattgtgaagcaaattcacagaaaccacagggaagggaagacctatgcagtacaattatcaaaatatagaagtagcaagctatgaataaaatctgcctttccagaaatattaatgtattgggaacatcagcttattaaagtctaatattaatactttagaacacttttactgcagtcattgcaaattataaagattaaaatattctaaaatcgcttcttgataattttttatataaaatttattttataattttctccaaaatcactagatgatggaagccttttaatcattcaacaattttactatgctacttgctggtgatacaaatacttgtacttcagtgtttttactaagtttacaggctagacaggaggactagtaattgcattttttaaactaatactaatcataaatcaatacaaatgttattcataatgatgtttatgaatggtactatttactttttatataatgccggtgtatgagatgtatagctgtaacactaagaaatcaaattcaccatcattataattttagaaaattagagaattgatcagtaaccagagttgggtagttaataacaaaatcataaacaaactatttacattttaagatcattttccaggtttaaaataaacctggtttgaaattaattgtataagcaaagtcatacaaagtgatattttctacatctttaagacatttatttgctcttggtcatattgaattctgctctagaattcaagaaaaccacaataaattttaaaaagacaaagacatacaaaaaagttttaaaacattggattatagtatttgtagaaggaaatttaaaaaatgattgcacttgggaagaaatttatggattaattaaccctacctagtattctacaaatgaaagaactgagatccttaggaactttttctattatatttcttaaggtaatgctgatcacaaacaagcatattttgcatctttctttctggtttgtatgacttttttttctttttcttgcccaatttctctggttacgacttctagtactatattaaatagaagtggtgaaagaaggaaacttcgacttgttcctggtcttagatggaaagcttttattttcaacactgaatatgacattagctaagggggcttttcaatttcagtctttatatcatactgaggtaattatcttctatttctggtttcttaagagttttatgaacacaggatgctgaacttgataaaacactttttatgtatctattgagaagatcatgaaattttacctcttattcagttaatgtagtttatcacattaatttatttttatattttgaaccatcattgcatcctagggatagacaccaattgattatggtgtaggataattttaatgtgctgttaagttcaccttatatattgaaaaccttaaaaacttcatttttttaaaagctgttagaactaatacaaaaactcagtaaatttgcagggtacaaaacttcacatatgaaaatcaattgtatttctatacactaacaacaaactatgtgaaaaagaaattaagaaaataccattaccaataggaccaaaaataataaaatacttagaaataagctaaagagataaaagatttatacactgaaaactacaaaatattaatgaaagaagaaataaacaaatggaaagacagcctatgctcaggattcaaaggcttaacagaatagagagcccagaaataaacccttgcatatatgttcaaactaatcttcaaaaagggtgccaagaatacacagtgaggtaaagcaatctcttgaacaaatagtgggaaaactgggtatccacatgcaaaaattagaatttgacccttattctacatcatagaaaaaagttaactaaataaataaaaagactttaatgtaagacctgaaactgtaaaacctctagaagaaacacacagggaaaaagcttcatgacataggacagagctatgattttgtggatatgacatcaaaagcacagaaaacaaaagcaaaaatggagaaatgagactacctcaaactaaaaagcttttgtacaaagaaaacaacagagtaaacagtcaactacagaatgggggaaaatatttgcaaaacatatatctgataaggggttaattctaaaacagataaggaactcctacaagccaggagtaaaaatcaaacaaacaaaaacgaatacctgattaaaaattgggctaaatacttgacacttttcaaagaagtcatacaaatgaccaaaaggtgtatgaaaagatgctcaatgttattaattatcatggaaatgcaaatcaaaaccacaatggggtatcacctcacatctgttaggattgctattacaaaaaaatagacaaaatagtaataacaagtgttggggaggatgtagagaaattggaaactttgtacactgttgatgggaatggaaaatggtacagctggaacaattacaaaaatagaatttgcatatcaaccagtagtcccacttctgatatttgtccaaataactggaatcagggactcaaggcgatatttgtacctccatgctcattacagcattagtcacagtagtcaagatgcggaaatagcctaaagattcattgacagatgagtagatgaaggaaatgcagtatgtacctgcaacagagtatcattcagccttagaaaagaaggaaatcctgccatatgtgacaacgtggatgatcccggaggacattatgctaagtgaaataaaccagtcacagaaggacaattactgcattgttccacttatatgaggtgtctaaaatagtcaaacccacagaatcatatagtggaatggttgttgccagggactggtgggaaggagaaatgggcagttgctaatcaacaggcgtaaaatttcagttaattaaaatgaataaattctagagatcttcagtataatgttgtgcctatagttaaaaacactctatagtgtacttaaaaatttattaatagaaaagtctcatatcattttcttaccacaataaaataaaaacttaaatatatatattttatatattatatatttaatatatattaaataaatatatattttatatataatatataaaatatatatttaatatatttatatgttatatatatttatatataagttatatatatttatacatgttatatatatttatatatattatatatatttatatatgttatatatttatatataagttatatatatttatatatgttatatatatttatatatgttatatatatttatatataagttatatatatatttatatactactcagccattaaaaggaacaaaataatatcttttgcagcaacttggatggagctggaggccattattctaagtgaagtaacacaggagtggaaaaccaaaaactgcatgttttcacttataagtggcagctaagctatgagtacacaaaggcatacagagtaatataatggaccttaaagtctcagaaggggagggtgcgagaggggctagggataaaaaaaattacacattagtttcaatgtacactaaaatctcagaattcaccactatataattcatccatgtaacaaaaaaacacttgtaccccaaaagatactgaaataagaaaaaatatacatacatagatagagacacagatagataatgtgtcacagatagataataatagatattattataaatgaagccaaaaatttcaatagcttaaccaaataaatgtgtatttacttttaatagaaaaatctaatgagagattcagattgcagacatatcttctctaagaaacattttgtagatccagactcctcttttcatcttgtagaattgttgtttccaagatatggtgctcaagtttgctaagctcacctatacaaagtcagctgtggaataaagcatgaggaggcttttacatggaagaatttgattggccaaacctgggactaggacgaacatcccaactaagtcacatgtcaaatctaatggaaaggaaggcagggaatatccatctagttttgtatgtagaaaatggagaaagagaaaaccaatctgccacaaatcattcttggcacaaggaaaatttgatgcagattttcaaataatttcttttgtaaaattcaatgtaatataagacataaatattgtctaaatataaggtaattcttcatggtcatctaagtccatataataatattttataaatcattaacttttaactcagaatgaaatcagagcaataattagattatttgtaattgttggtaactgatgtagtatccatcttgaagatattttagagaaattgtatgaagcactgatatttttcaataacactgatgctccatggtgagcagatatattcaaacctaccctcaaggtccgagggagctgaaaggctgaagaaagaggctgacagatccagtttatcagaaggaaagatttaatagagatgtaagaacagaatcaatgtcttgaaaggccacaagatggtgtatctccacactcactctccagaaaatgtccttcatttagcaagcatttagggtaaagacatatgtggttggtcacatctcagacttttttgctgaaactcttgaccactgggtgaaaccacacttgcaaaagtataacattgagagaaagctgatataactgacctcatcttacttgtaatctcataagcctctgcttattcctgcatgtaggccaagctaactgtgggaggaatttatagttgaactttaaagcaagaatgatgattgttccttcctaaaactaacaccttccttgttcagggacgaaaaccacttctgtaaaactaatgaaaggccacaaggttagaattatactagagacttgaattctgccaagacttagacatagttaaataataactagtcattgttttctaacttgcctttttgtaaatgcttataacttagaagtctggtatgatttggacatatgtccctgcccaaatctcatgttcaattgttatccccagtgttggaggtggggcctggtaggaggtgattagaccatgagggcagtttttcatgaatgatttagcatcatcttcttgatgctgttcttgtgttagtaagtgaattctcataagatctgactgtttaaaagtgtgtagctcttcccccaaccctctcttttgcacctactccgggatgtgaagtgcaagatcccccttcaccttcagccacgattgtaagtttcctgaggctttcccaggagccaagcagattccagcatcatgcttcctgaacagcctgtagaaccatgagccaattaaaaaacctcttttctttataaattatccaatctcacatatttctttatagcaatattagaatggactaacacatagtcactacctggtggtcataaaatttgtaactttcctaattgaccctatagataacatgactactgtaaaacctaagactggagtttgagatatttttctgagtttgcattctggtggaccaactgatgccagctggaccagtgacctcacccagaaactgactcagcacaccaagagagtttcggcatttcaaaaccgtgatttcatttctaacacagtcaatcagtagaaacaattctgtaggccctgcccaccaaatcatccttaaaaatccaagtctgcaaagtctcagggagatggatttgagaaatagcttgtgtccttcttgcctggctgccttttgattattaagctcattctctgctgcaacacccactgtcatagtgcattgagatttgcctgtcatagtgtattgagatttgcctgtcatagtgtattgagatttgctgtgcagcaggcaagaagcacccattgaactgttacattgggagattagataagaatctatacaaggagttatttatattataggcattgctttaagaccatgctatggaacatgttggtaggcaggactcaaacatcagtcatcatggaggctttgcataaaggtggcatcacttttaccatgcagcaggctgtttttcaacaactgatattttgattaaaaaataggaacattaaattgattatactgtcataggtcttttattcaataaataaatattttcttctgtttttcaaactcttcttgctcttactttgattttattcctatattagttagttcttacattactataaagaactacctaagactgggtaatttataaagaaaggaggtttaattgtctcatagttacacaggctgcacagtaagcatgacttgcaggcctcaggaaatttacaatcacggcagaagagtaaaagggaagcaagcatgtcttcacatggcagcaagagagtgagagagcaaggagagaagtgctacacatttttaacaaccatatctcatgagaactcactatcacaagaacagcaaagggaaaatctgcccccatgatccccactccccaccaggtcccttccccaaaattaggaattaaaattcaacatgagatttgggtggggacacagagccaaaccatattattctgccctaggctgctcccaaatctcatgtccttctcacactgcaaaacacaatcatgtcttccctcaaatcccccaaagtcttaactaatttcatcattacctcaaaagatcaagtacaaagtctcatgtgagacaaggaaagtcttctgcctatgagcttataaaagcaaaaacaagttagttacttccaacatacactggatgtacaggcattgggtaaatgatcccatttcaaatgggagaaattggcaaaacaacaacaacatcaaaaacagggctacaagcaccaagaatgtgtgaagcccaacaaggcagtcattaaatcttaaagcaccaaaataagctcctttgactccatgtctcacatcaaggcaacactgatgcaaagggtgggctcctaaggcttgagtagctccaccccggtggctctgcagggaatagcctctgcagttgctttcatggggtgatattgagtgccttttggcttttcaaggttcacagtgcaacctatcaatgaatctaccattctgaggtctggaggataatggtcctcttctcacagctccaatagggctgtgttccagtggggactctgtgtaggtgctggctccaaacccacttttctcctctgccctgccccaatagagaagctctttatgagtgttctgcccctgcagcagacttctgcctggaaatccaggcatttctattaatcctctgaaacctaaggagaggcttccaagcctcaattcttgcattctgcatatccacaggcccaataccacatagactctgccaaagtttggggcttacaccctctgaagcaatggcccatttgtacattggccccttttagctacagctggggctgggaaggctgggacacaggatgtcttgtcccaagactgtacagagcagtggagccctgagtctgtgtcacaaaatcagttttccatcttgggtatccagtcctgtgatgggaggggctgctgcaaaggtctctgacatgccctgtagacatcttcctcattttcttgggtattaacattaagctgtttttacttgtgcaaatttttccagttggcttaaatttatccacaaaaaatgggtttttcttttctaccacatggtcagcctgcacattttcaaaactttaatgctcttcttcccttttaaatataagttttggtttcagatcatctctttgtgaacatacatagctgtatgctcttaggagcagccaggtcagttcttgaatgctttgctgcttagaaatttcttctgccagataccttaagttgtctctctcaagttcaaagttcctcagatttctagagcagaggcacaatgccaccagtctctttgctaaagcatatgaagactgatgtttaatccagttcccaataagttcctcatctccatctgagagctcagcatggccatctctgtccctatcactaccagaatgttggtaaaagccattcaacaagtctctatgaaattccaaactttccgtcatctttctattttcttctgagccctccaaatggttccaacttctccgtgttacccagttccaaagttgtttccacatatcttcacagcagtaccccactccaggtaccaattttctttattggtctgtttctacactgctataaagaactagctgagactgggtaatttatttaacaagacatttaaatgatttacagttccacaggctcaataggaagcatgactgggaggcctcaggaaacttacaaccatggcagaaggggaaggtgaagcaagaaccttcttcacatggtggcaggagagagagacagtgaaggtggaagcagcacacacttttaaaccttcagatattatgagaactcactcactatcatgagaacagcaaggggaaaatctgcccccatgatccaatcacctccaacaaggcccctcctcaaatttgacatgagatttgggtggcaacacaaatccaaaccatatcaatcaataaggagaaaaacaaaaaatatttaaagatacctgttttgttaaactatggatagaatgaataagatctaatatttagtagctcaacaggatgactctagtcaataataatttaattgtacatctaaaaacaactaaaagggcataatttgattgtaacacaaagcctaaacgcttgaggtgatgcacacctagttctccatgatgtaattattaggcattgaatgactgtgtcaaaaaatctcatgtactctataaatatatatacctactattgatacaggagttaagaataaattacttaggcagatagtgagggtatgaaagtcctcagtaaggtttttctttttaatggaaagcatccaccaatcattttctgacatagagcaacccgtgaagttgagctgcagacatagacaagcaagctgggagcttgcatgagtgaatgctgacaggaaagaaatacctgggactagacatgttcaaaatggtagcttcatcttcccttctctgccagccatgagtacagtaaagagcagacaagatggaactggccaataataataatcttattatttgcataataagattatggtggggtgaccaacctttcccacatgctatgtaaatgtcacacctgatcaaaccaatctgtaagccctatgtaaatcaaacaccacctcctcaagtaggactataaaatccagtgcaactgccaccagccggccttttcctctcagaagtcccctctctctcactggagaaagagctatttttctttctctttcttttgcctcttaagcctccactcctaaactcctcttgtgtatctgtgtcctaaattttcttggcatgagatgatgaaccctgggtatttaccccagacaatttagccacttcattgtgtagccacaaaaattagaaattatttttttttaaataaggagaactataaaagaaagaatacttgaaactatattaacaagattatcttgggtactataacttaactgacattttatcttaaaatcttgatgcttattagaattttagaacgcctagtgacataatttagtgaaactgtaaattcattagtaattataaagttaatttttcaacatggtttatttatgtgtctggaattggttccttctgatgggttcttggtcttgctgacttcaagaatgaagccacagacccttgtggtgagtgttacagttcttaaagatggtgtgttcagagtttgtttcttcagatgttcacatgtgtctggagttttttccttctggtgggttcttggtctcgctgacttcaggaatgaagctgcagacctttgcagtgagtgttacagttcttaaagatggtgtgtccggagtttcttccttcagatgttcagacgtgtccagggtttcttctttctggtgggttcgtggtcttgctgacttcaggagtgaagccacagaccttcacagtgagtgttacagctcttaaaggtggcgcatctggagttgtttgttcctcccggtgggtttgtggccttgctgacttcaggagtaaagctgcagaccctcgcagtgagagttacagcttataaaggtagtgctgacccaaagagtgagcagcagcaagatttattgtgagaagcgaaagaacaaagcttccatagcgtggaacggggacccaagcaggttgcccctgcgggcttggatggccagcttttattcccttatttggccctgcccacatcctgctgattggtccattttacagagcactgattggtccgattttacagagtgctgattggtgcatttacaaacctttagctagcacagagcgctgattggtgcattttaacagagtgctgattggtgcatttataaacctttagctagacacagagtgctgattggtgcgtttacagtcctttagctaggcagaaaagttctccaagtccccacccaacccagaagcccagctggcttcacctctcatttatactcatttttagtttaaaatattttcaaaaactaaataaaacacatttataatttttaaggttttatcttaaaatttgcctctttttgtgagccttatccaccaatcaatatagcctagaattgatcattttccattttattcatcaacatttaaattcgtttcattatcaagaaatttcaccttgttttacctgtcatactactccttaatacattttttctattgatctcagtaacatttatatataaggcctagggcagcaccatctataaaatacagtgtactgaccaaaagaatagtttttgcaaagtagaatttgcttgggtattcctaggcctagaaagacaaagatgtgcagaggcctctttctaagacctctattttagtgattgataatttcccaaataacagcaccagggaagagtgtaaaaatccccaattgtaccaaatgggatactatgtttagccagtgtttcaaaagtgcctttcttattgctcattataaaagggaatgaaattatttgggatatttagaaaatgacataaaaggtgtttttttaatactggaatgtggctgtcaaatggttccttcactggctgttatcaaattcaaatgcatagctcaaaaaagtaaactgttcataatgatttcctgactctaccactccttcctatttagaatacactctccccttgcatgccatatgtatcagtctgtcctcacactgctataaagatactacctgagacttggtaatttataaagaaaggagattcaatagattaacagttccacatggctgaggaggcctcaggaaccttacaatcatggcatgcagtgaagtggaagcaggcatgtcttccatagcagcaggagagcaagagtgaaggaggaagtgccacttttaaaaccatcatatcttgtgagaactcaatcactatcacgagaacagaatagaggaaactgcctccatgatccagtcatctcctacaaggtccctccctcaacatataaggattaaaattcaagatgaaatttgggtggggacagagagccgaactatatcactataatgccataattccatattttccttttacctctccactcggctcactgcaagctctgcctccctagttcaagtgattctcctgtctcagcatcccgagtagctgggattacaggtgcacgccaccacacctggctaatttttgtatttttactagagacagggtttcatcatgttggtcatgctggtcttgaactcctgacctcgtgatctgcccaccttggcctcccaaagtgctgggattgcaggcatgagccaatgcgcccggcctccttcttgatcttttaactttgaagattctcaggaatttgtctctcttataaaatgtcttctacctttgatagggcatccatttctagacattcaaaggcactgtcttaaatgtgtctagactgctgcaggtcttctgatctctaaggtaacatatccaattgcctaaacaacacctctctttgaatttctcacatgtatttatatacaaacttaactcatgatacttccaaaccttcactttctctattaatcagactgatgccccatcagtcgcatgcagcatccaggacttctcagataaaacttggatctctttctttctttatatgcaatcaaatcatctgctcctgccagttctagcaactatatctcaaacttgttaactgctaccattgtggttcaagctaccataggtgcttagttgctttaaactacgcaactgaataaaaattaactcagaataaacatagctctgcaacttgattcttcctatctctcctgcctaattataggtttctctccttgctaactgttgccggttatacttgtttcaactcaatcttaaagacattttcttcttcttgcctctgggccatcaataaagtactttatatgtataacacaaaaacttattcttcaaatccttatatgtcacttaagaaagtctaccttgaccctctgatttaggctatttaacctcaatatagattctcttgtcaacctgcccttcttcatttatagcttttattatcattgtttaatgatgctttttctaccctgatttaaattcgtacccccaatatttactatagcaactgctacataatagatgctcaataaataattgtgggatgaattaaattgatgagcaaataagcacattttccaaggtgcacatcaaaccttcatgcttgttaaaaaggttcatttccttttgtcccttttgcagatgtaacatggagcaatgctgtcactgggtgctgtgagatttcgattgagatattttctcatgcaggtagtttctgaatggtgaagcaattacaacagagatagagcttggatgagaacaatatcactaaattctccagggacagttcaaatacaagcttattctaagcatgatagcctctgcagcatacctgagtaaaggttcttaaatctggctgcacattagaatcacctggggagttttgaaaaaataccagagctcatgcttcactccagaccagttaattcacaatacttaagggtaggtttggacatcagcttttatttgtttgttgttttaatgcttccaggtgataatactctacagcttatttcgagaagtataacattggctccctaacatgacatcattagaatattttgtagtaatttaaataaaatagaatcagacttagacctgcggtaacttctttagttggactggaattaagctcgataatatgtattttaaaaggtctacttgtgattctgctattcaaacatttaggaaacactgattcataataatggactcagtattaaatatataaatttctgtggatccattatctgaaaagcaaaaactttaacgctatagcataaagagtgatagctttgctaaaagaaatacgttttttaacaaaggaatgtcttctacataccatcttataagctcaaagtgcaattttctaaaatgaaatgcaggtgaaaaacctaatatagaggagagttgtcagaatttttttctcaaaaatgtactcactgatggtatcagtaggtaactttgggcaaatatagcagatatactagcaatatcttatatagaaatgagaaaatttaaaatgatagtcacaaaaattccaccacttaatttgacattttctaaaattgatatatgatttaaattttagacctaagtgaacaaaatattttactcaagggtcaagtgctgtaagagacataaatctactcaaagtaacttaattttaatgtggagtgggaggcagtaatgattacaaaaaacaaataggcaaatcagacataaagggttggtattcaaaaacaggtcaaacttaagtgtgattataaatggaaaggcaagaattaaggttaatatttctgtcttctggtgtctcctagcttctcttttctttgcttctctttgcataccagattctctctctctttttctactttccttcttttctgttttttgcttttccctttattatttttttgaacatggcctacctctaacttaccaaataattttgggtcaaattattgagagaaaataaattggtttctagattaccaaaggactggttgatcttggtcttgattttagtaagatatgacctaaagggcaagaattataacctccagtattttcaggagtatcaattctctgtttatgtacaagagaaaagcagctgtctctccaaacccctcttgagagaagggtgaaataaattctgctcctttgatataagttagaaagaatcctgggttctcacctaatcttttgaaatgtaaacatgcctttctaagtcccaaataaactctaggtgccttctgcttctatgaaccagagatgtctccacatctgggcttcatctcttaaaatataaatagtgagggagatagcatttcatgctttctactaccttggtagcttaaaccagtgttaaaaaaaaaaaaacaattgcatcagatgcttgttaaaaatggcaagacagattttaggtaagctatcacaattggcgtatgcaatttctgtatagaactgagctcatctccaaacacagcaaagacagctgaggatatctatagccaacaagcagagtgagggggtcagtggagggaaaattactaagaggaacttgattagatattgattagttatcaatggtggggagatcttgctgaactaaattagcaggattctaatatgattgcctcagatctaattattacattttcatatatggtgaagagaggtgaatctttcattgggctttccttttcactaatttatctccttttggctaacttagtcacacactccaaaactggcagaagataattaaattgcatttaccagcttagaacagtcatgcctcctcaccttgacctgggcacactgggatactataaattaacaaaaaatgaaagaatatcttgaaaaataagataaatgatagtgtctgctctgccagtgtaacttatggtgatgaaaaatacatactcttgcctactgttagttggcaggagtgtaaattctcagaagacaatttgctagtatttctaagaattaaaaatgcatcaaatgtcattatgagaaagaaaattaattgtgattaacagcaaataggaaataataatatcatgcattccactttatgtgttactatccagatattaaaatgaattgacattgactgtaaatcaatcaggtgatttacttacacctgatacagagtttagccttgaggacgtggcctgaagctactgagtaaagagcagaagagtagagggtcctgaaagtcaatggatccaagacacatcacctctgccccaagagtattggcaaggggctatcttggaattggcttgggagtttgacctggaaagggaaggcggcctcagctaaaagagactagagttttacaggcagatagccatggactgttggcaattagctagagaaatgcctgcatctgccatgagaaaaactcaggcaagaaaagtctagtgatgaggaggccttgtggaacaaaaacactcatctgagaagctcagagaacaggtatgctagtttatgagcatttcagtgtagtaagacctttccagcctcctaaggttttccccctgcctatactgttttgaccctgtggaattcagaaatcacacataataagctggcagaaaagggagaaggagaaagtgtaaaacaaaagacaacgagaatgacaaccctctctcctccacccaggcccagtggggtttccaccactaaccaccctcctggagcaagcccaaactggggaaaagaaaagttttaaagtagaataaaatgacactgcagtgaaaatgttttgaggactggaagttactagaagactttttgttattcaaaagtgactggaaaattcatgctctttgcccaacattccggcgaaaggaagggaatcattagttctacaggtaatgcttggaagaacatttgaggaaaagtaccaaagagacttactgattgttcctaggcgtctggttagctctttacttaatgtaatataaataagagacattcatctgtacatactcaaaaacatataaacaggtatgtgaagtaatcctaaaaaactgttactttgatggagtagggagtagttttgcttaattttgcagcttatgataatgtatagttatgcatgctgtatttgcattacatatacagttttaaacatacatatgcatataatttttgtacatgtacatattatgtgtgtatatatacatagtgcatatgtgtgtatgcatatataagagtgtataaatgcaagttttttaagagttaagaagatgaggtgtttataaccaatttgggaaatattttcttatcatacattctgatttaaaggaaaacaaaaaacaaaaaaacaagactgggtgcagtggctcatgtctataatcccagcactttaggagactgaggtgggaggattgcttgagaccgggagtttgagatcagcctaggcaacatagcaagatgctatctctaaaaaaaaattaaacattagccagattatggtagcacatgcctgcaatcccagctacttgggaggctgaggcaggacaatcacttgagcccaggagctagaagctgcagtggacaactgagcgaggtcctgtttcttaaaacaaacaaacaaacaaaacagaaaaaaaaaaccctctaacaaataatgtcttcaaaaaatgaagaaggacagggcatagaagatattctacctgggcatattgaaattcaattcaatagaaaggaattgtgtaattcttcttcatgcatggagtaaaagttatatatatttaaagtaaacatgcaaaatgttcaacatttttgtgaaagataatgcttaattctatgtattctacgtggttcaaattccaagtaaaattatagattttccagcatcagatcctgacggtgattgagaaatatcacaatgtaaatatcagatgctttaattttcaatattaaaataaacattattttgcttatataccacagaattgagttgttcaatgctttgctagatgaccagtttaagaaaggcgtattaagaatattatatcatttatgtgaaaaaatgcaaattaaaatcataaagaaaacataacgtctgttcctggcacttgtatgatatctgtttaaaaaacagaaggataattttatacatattttataacatatgtggttttaaacctccaagccggatacatttaccaagctgtctgcaaacacattttttaatcttgaaaaagaaatgtgttaaaaattttaaattacacataagtggatacatgaaaatgaaaggcaggcagttctggcattttgtttttcctttacttctaatttttacttaaacaaatgggcatccaattcaattgtcctatatatttcctggatcaatatcatgttagtagtctgttatatttatgtcatgattacctcatatattgtaatacgcaacacttaaatgaaatagcatcttctatgttatccagccagacttagtcattgacagaaggaaatataaaaccaagagaaattaagtgattgcactaaagtctcacaatcatataaaggcatagctgtagccctcaaccaggtttatatctattcatatccatagctatacacacacactctatatataaatagctatacacacataaacacacatcaatgtctctgttaataagcattttttacatgtcacataccagttttctggttttctttttttcttttcttttttaatataagtttgttacagtttaacatgcacagagaaatcataaatatatttatcaaaacattttctcaaggtgaatatacctacttagcacccatatcgagaaattaaacattaatagcatctgagaagacccattttgctctcagtcactaaaccaccacaggaaatcgctatcttcagtattaacaacctaggttattttgtctgtttttttttttaactttgtataaatggtaaatttagtatgcacttttttacatttggcttctttaatgcaacataatttctgtgagattcatacatatttttgtgtataactatagaaattcattttcttgccatacagtattttattaaaatatcacattttagttattcactctactcttgacactgtttagtagtgcacttgcaacgtatttttttgttttgatttttagccattatggaagctaattgttcagctaatgtgaggagtgctagatttccaattataattgagaattcttacttttaaatttccaattctttcagtttttggtttgtgtatttcaaagtgctgataatggctgcatacagaattgtcttcttgataaaagtgactctttttttcactttgaaataagcttctattttctaacaatatttcttgtttttaagtctactttttcccagttaatatttattgtgataagaatgttcatagcacagtatatcagccagtgtatctctatatttaattatgtttcttgtagacaacatataattggatcctggttttttatcccacttgaaaatctccttttaataaaattattttatcatgtacatttacatctctttaagttttatttgtcatgttgacatttattctctgttttttaaaatggtttctttattcctttcctccccatttcctgccttattttggattagtgtatgcatttagattctcttgcacctttactatttttaggtgcaattattttattgttttagtggctgcttgagttttaaatatgcatctttaaattatcacagtcacatttcaaataagagtatataactttaggtataatataagaattttataataatataccatttccccacgacccaatattttgctgtatttgacagatattgtacttctacacaggttacaaaagcaaaaataaatcatcgttgatatggtttgaatctatttcctcacccgaatctcatgttaaattgtcatccccaatgttgaagatggggcctggtgggaggtcattggatcatggaggtcgatccttcataaatggtttagcagtatccctttggtgctgttcttgtgataaatttctcacaagatctggttgtttaaaagtgtgtggcaccttctctctctctcccttgctccttctctggccatgtaagatatgtctgcctccccttcaccttccagcataatgctaagttgcctgaggcctcccaagaagcaaaagccactatgcttcctatacagcttgtggaactgtgaaccaattaaacctcttttctttataaattacacaacttcatgtatttcttcatagcaatgcaagaacagactacttcagttattaattttgtttccaaaagttgaaaggaatgagttaaagtagctggatggtgatccattgtctccttttacctgagaaaagtttctaggaggaagaagggacagtaaatacccagagaagcatctttgccaactagacatcagatagattaaatacattgttaagaagaattttgatcgctgagatagccttagttgaatgttccatcgtaaatattaggttggtgcaaacgtaattgcagtttttgcctttaaaagtaatgacaaaacccacaattacttttgcaccaacctatagaacctagtgtatatcagaaataatccctgcaaatgtcacatagtttatacaaccctctgggctgtttcattgtataaatatccccactttgtgaggagcctcatgagccttagctagagatctcttctattctaggacaaaggggcatatcttggatggaggaagggttccctgatgtcccagatctctctttttatctgaaccatttttgttgttgttgttggttttatgtttaaaataatttagtaaaacatgatacttggtaagatctctggttctgtgagtttgttttgacattctcatcctatgtggatctcaaaaatcaattatttttcatagagatataaaaatgataaaactcttctttgtagataccctcatatttaccatttggcacaatcttaattcttttgtgtagccccacatttccatgttgtaatgtaggtctcctgttgacaaattatctcaacttctgtttgtatgtattttttaaacatatttttactctgttcagaattctgggttttaagggttcttttataaatgctttttattcagcattttaaaaataacttttaattatttcctggtctgactagtttctgatgaggttggctatcattcctgtagttttccctctaaacttacttgatttatctttgtctccagtggctgttatgattttctctttaacactaattttaatcaattagattataccactatttggtgtagttttcttggagtttatgccacttgcacttacttgagctttttggatgtgcacatttagagtttttgtcacagttagataattttcagcccttatttctttatagatttttgttctgcttctcccttttctcttcccctacttagacttcaattatacctatgttagaccacttgacattaatccaaacattatagtccctattaacttcctgagacagacttctttctatattttctgtctctttctcctttaatttcttgctgtttctgttgatttctatgtattccagttcatttatcttttttgctgtctaatttaccattaattctactcacagaatttttcattttagccattgtatttctcctagtacattttccttaatttgtttttttttaatttttgatttccatctctttacattgatgtttaactacttgaaaatactttaaataggtactttaataactgtgttctatatctatcatctcttttattttatgtatgattatagtaactgaatattttcctagttattggtcatattttctggctgcttcaaatacctaacaattttttaaaattatttattgctggctactatgatatttacctgaagtactgatattattatgtatggttaatgatttattttttcttatgtggatatataaattagccagtaacatttattaaaaattgtcatctatctccaatgcattaccaatgtcaactttgctgtaaatgaaacattcgtaaatgtgagagtatgtttttgacatttctcttgttgctttgaactacttacaatttttaaataaatactccaactttctatttcttcttttgacaattttgataacttgcttgtttcaagaaacttgttactgttatgtagtacttaaaattactggcagacatttgcaggtgatataatctcctatcttcataatatccataacatctttttaaattttagttatgcctcttttatttcatataatggtcatttatactctttttttaatccataataagttgttactgtaactccaaggatttggactaggttccattgctcactgcacagaaagccaatcagtgagacaatgagtattgacagagaagaaggctttttattcaggtgatgtcagctaaatagatggaaaccaaacctcaaatccatctctcccaattgaataaaattgttggtttatagaacagggaagaaatatagctacctgtgggaaggaatgcagcaggaaaacaggaattaggaagggataacaaagcagtcatgatggatgagaggtctggggtctgattgtctggatgtggttatctactgtgtttcaggtccttgcctgaggtttggtttcctgaaaaagaaactcagataagaaaaacgtaagattcgagttttaagtccaggtagagtaaatttctatgtttattcaaaaaaatcataaatattagttttatgggacaatttggctggtttcaaagtattgctggagatctattaataatattcaacttgataaaatcaaaatttggctttatttatgatttttctattgcataaatttataaaatatatttttcctcatttatattatttctttatctatatttttttatatttctatcaagaaatataatatttctatatttaaattttatcataaataaaaattaacttcaaattgattttgttggcaaaacacaaggtttcgaaatacttgttcaaattttaaaacattttttccttcataattctgaaacatgtataaagattacataagctcagtcatcatataattaaagaaaaaacatgaccccaaagggaccaatgtttaaaagaagaagatagcaatgtggcattttctaaagtgaaagatttgtggaagaagtgtagacttgggttttacagataattggaggaactgctagccacaatgagttatttgctttagaatcctggaactgggaatgtgtgtgtgtgtcaagaagttgggggagttggtgattagaatgatgtccattttatatgacatgaagggtgtttccatcaagaacttttaaaatgaaacagcaataaattatctttgaggttctagaaatttcaatgcaactacctctactggtgatttatattttaaaaacaaaatgccagttatgtttttagaaagtcctctctctttcaaatcgtgaaagacaatttttattatttaagggcaatatataaacattatagctgaaactcaagaacagtagtatttaaatatctcttgcttctgggaaatgttcattctcatatcatacaggatacaagaaaatccttcacatggttgggcacagtggctcaggcctgtaatctcagcactttgggaggctgaggtggcagatcatctgaggtcaggagttcaagaccagcctggccaacatggcgaaatcccatctctactaaaaaatataaaaagtagctgggcatggtggcaggcgcctgtaatcccagctactcgggaggctgagggaaggagaattgcttgaacccaggaggcggaggttgcagtgagcctgagatcatgctgcactccagcctggctgacagagagtgacaccgtctcaaaaaaaaaaaaaaaagaaaagaaaatccttcacatgccactctcataatttctacagattcttctccactttgtactaaagtaagagacaagcattctctcaccacagtgtttaatagtgaagatgtttgttagcaacagcgctttttaccaaagggacctggcaatcatttacagtttccaacaacatcagcaacaactcacctttgttaaagagttgctatgtaacaggcatttttctaagttatcgtccatatatttggggttgcttttgagtgtagtggcacaatcatggctcactacagcctcaacttcctgggctccagtgattgtaccacctcagcctcctgagtagctgagaccacagatatgaacaactacacctggctaatttttaaatgtccttttttgtagagatggggtctcacgatgtttcccaggctggtctcaaacttctgacatcaagtaaccctcccacctcagcctcctaaaatgctgggattacagatgtgagccactggcacctggccatattcacttcttgaatcagcataataaccctataacgtagggctatttcttacctattttaaaaagagaactattggaggcaaacagttaaataatttgcccaaatgttgtgtatatatgtaacttatttatctatactgtttatcatcgtctaaaggagtagtctaatttttttcagaaccatgttagtggctcatgcccgcaatctcagctacttgggagactgagaagaaggattgtttgaagacaggagttcaagaccagcctggataacatagtgagaccctatctctaaaaaaatttaaaaacttatccaggcatggtgatgcatacctataatcccagctactggagaagctgaggcaggagaatcccttgagctaaggaggtggaccatggagtaagtgatccataatcgcaccactgcactccaggctgagagacagagggagaccttgactctaaaaattaaataaataaataaataaataaataaataaataaataaatagaaaaaattcagttgaacaacagacatttgattgtatgtcctgtacaataattcatcttctttggcttattcctatttcagctaaggcattagcatacttaccatacattctgttatttaacatttttctaccaggtaaatatcgctaatatactttagaataaagaaagtagtttaatgttttctaggtcaacttctgacaatataaggcatgtagttatatagagaggtgtatctttctctagcattgataattgttttacagtcttaatgtgtatgattttataactattgcatctctgtaatccataatattttacctatatttctaaattgatattataccacttttttcttggttaacaaagatcagttttataactaccaagatgatccttacttctctcaccaaatcaatgtaaatatattgtaatatggacctctcctacttttctctaaagattttcctgaaaaatggattataaacagacttgagaaagcatataacaatcactaaaataaaagatgtcacacatctcctgcagctaatttatttggggttctctgcttgttccttccagggtttctttaagcataaggtggtaatggctcctcagttgttagctccaagaagtttacctcatcctgttgggcttttttctactcctacccatatctctctttatggagtctctccattgactccataacaaactgttaggccctctgtaagtttatccttagtaaatctcctctactcagtgatacagaatctgagaattactcatagaggataatttatagagataattaagcagaaagataattattaaaaagactttggcatctggttttctctgtaactctaaagtttttttctcatatttttacagctactctatacaggtatgataaatcaatttgaaagaataaaacatactataatagcattaataataacattggatagagccaatcagcaataaaaaggcacaaactactgacacatgaatttcagacatgatgctgtgtgagagatcaaacacaaaataagcacaaactcttctaagccatttatacgaagccataccatgaccaaactaatttatagtgatagaaaccagaacagacaatacttgggggggcagactgataaaaagaggaatgaggcaattctctggggtggtcaactgttgtatgttttcatagaaatgcttgcatttgtcaaaattaattaaacttatacaatgtatgtacatcatacctaaagacataacctataaaaattgaataagcaacatgagagttaagtgctttgttgttgacagcctctgattcaggaagttagccatctggaattggggatgctgaggaaaagccctacctgtaccagttctgcattaactgccatggacatctgttcatcatttattcctgtttggccaagattgtccccatttatgtatattttcccaatggattagttaatttcacctccaatcactcccaaaattgaaccagtttgaaagataaataatatggtcatattagaattaattagccacaagagaaagcaaaaccccagttggactgacagaattagttagcttgataggctcctcagcaaacttagtgaaatttgcataagcatcttgttcccatttacaaactcctaatctctagtgctcaatatcagaaaatgcctcttgagacattctctcttacttacacttttccccagtcaactctctatttgcatcttctaatcagtactttcaaatctttattcaattgaaaaaaaagtccctgaaaatctgaacttgacaaataattacagaaggctaatcctcaagttgtttaaactcaatcaatataaaacactattcgacaccttgcttcagaaaccagcttctcccataatatctaattgtatctagttgatagcatagtaaagtatcttaaaaaatggacccaaaatgtaataaaaataaacttatatttctttcttgtttcttcgggaagaagatgaggaaagtaccactactctccatcatttaacccaggctgacagcagctccatcatcttcaatatataacttccaatgtctccttgggcattaccctcccaggtagccagagaggaggaacaatcatggagtaaaataagtagtgggagagacggactgtggatgtaatagattcggtattcacaggacgcacaatacttctcactttttattacctggaacacaatcagatgaccagatccaactgcaaggaaatatggataatgaagtgtacatgtacgccaggagaagggaagaagatggatattgataaagagcaatttctgccacatgtgctgataatctccctattggtcttcctaattctcctttttcctataatacattatttatatcacagacagagaagaattatagtaaaatatatcacattatgtacttcgctgatacaacttctttacttccctattagatttatgatataatccaaattatgatggacagactctaaggttctagatataataggtcctgactcacatcttacccactgggctccaatgacacagccttgaacttacctaatttgttcctggtgtgaggtctctgtattaactgctactttatctattttctttatagctactttatgctattttccccatacctcaattatacttgttataattatgttcaacaatgaaaaaccaaaaattctaccatggtggtttttacaaaacagatttatttgtcttgcacaacaaaaatttaagggtagagtgtctagaaattttctggtagctcaatcataatgtaaatgaatcaggatccttctaactttctgcacaaccatgttttgtgtaggtcttttgtcctcatgaagaaagccatgtggtctacctccaggcatcatatccatacaaagggaggaataagaaggaagtcctcaaagtcttcttcctacaagaatttgtttatatattctgttaggaaagccctattttcatatttatttcttcatcacatagaccagaaatatgccctgttgacatttctacatgaaaagaaggttagacgttttagcttttataatagtaaaagcaagaatgagaagtactgcatgtagtttttggattaccaattacagcaacttccaaatcccagatcttcaaaagcacatttgctgatagtcattcagttttagattaaatgtcacctctttgaagaggccttctatgttgataatttcctatgtgccatcctatattattctttaccttgctatgttcctaagacgctaacttttgtggagggcttcaattgaatccttcacctctgacctgtagtcagtgagattctggagagtggaaaaggctgattgtgggttactcctctcccagccccctcctgcttatcctaaagttgtctctcctgcaacgtcctgcagctcctctctgtcacacatctcctatagctaatttatttagggtcctctgcctgttccttccagggtttctttaggcttaaaggtggtaatggctcctcagttgttagttccaaggaatttaccccatcttgttggtttttttctagtcctgcctacatctctctttatgaacagtctctccattgaactttttttaattgccctgtttgagaggaccatttatgtcttgccagcaacataacataccttttaaattaccaagtgtaaggtacgtcaccaatagccctattctcatcactctgtttttttcaatactctattttaaacttgtgaaggatttaccattatctgaaatgatttaattatgtatacaacgttcacctccccctagtgcaagctccttaagaataggcattatatctgttttgttactgttttatttctagtgtctagtatacagactgctgtataatttttgttcaagatttgttgaataaatactgtgaataaatttttgttcaagatttgttgaataaagtgcgacagggcgcggtggctcacacctgtaatcccaacactttgggaggccaaggtgggcggatcacgaggtcaggagatcgagaccatcctggctaacatggtgaaaccccgtctctactaaaaatacaaaaaaattagccaggtgtggtggtgggcccctgtagtcccagctactcgggaggctgaggcaggagaatggcatgaacctgggaggcggagcttgcagtgagtgagccaagattgcgccactgcactacagcctgggccgacagagcgagactccatctcaaaaaaaaaaaaactaagggctaaagtcatacttgttgattgaatgctgcctggacggcctcctcctgcaataacctgagctcccacatacctttagctcaacaccatgccccatatagattcaccaagaacacctctctataccaaatgtatctgcagttgaattctaccccttttctggatttccaagcttctgcttatcacaaaggtttacagtggcttcagatttctacataaatccttctttctttttcagtgaagatttctaagttaatttttttttctatactgtggtcataattatctttggccatgtaaactttcactaagcagtgaagtctatttcaaaatttaaggaaaaattacatgattgctgatgataaaggacacaaaggacacttgtactttggtttcttagttgtggacaaaccgacatgtttttttcattctcagaatatttatgctaatgtggctttatatatgtcatagttctaaatttcgtgtcaatgactgttttccgacattggttccaaaataggttaaatagtctatcacacttttataagtattaatggtttcattttctgctcagggcagtttcttaataactgtctttcattgaaatactttcatactcagaaattaaggctgcagagagattaagctgtgctccgaagcataaacattcaaaacacaacaggcaataggcacatttcagagtttctaattgagagattgtatatcggttggaaaaggcataaacaaaaggtaatctgacatagttataacatttgggttaatcacagccttgtttaagtgggatgattcatctacctgtgttgtgttgttattgttatatatattacatcatttggggatgaaatggagtcttttagttcccattaataaagtattaacatggaatatcttaaaagtggatacacacacacacacacacgaaaattattcagaaaatgtgtcagaaacaatattatgaaaaacaaagaaggaagtcaagattagagagatcagactcagcttgagcttactgaaaaaaaatgggcaagtaagaaatgttaaaagacttcatgtttgaagtcataaggtgataaacattaaaagagtgctaaaaagcccttatgtttatctttaaaataataggtagcttcggaggaaagccaacatagaaggatgaaaataaatgtaatttttcaataatattgaaagggcttggcccatctctgatcagcatgtcatggctcgatatgcttcattctacttaactcttctcttctccaaaattctatgttgcctttcaaggaaggtatcatcatttacacaaaggtgggcaggcatcacgtgctgtcctgctcacctgctgccacagtgcaactttcagcaaattactctctggctcctgtcctcgtataatttcaaaaccagcaacccaaaataaaattaaggaaaataattgcaaagggatttaaagaagcagaaagagaaattcagcaaaagcatgatgttggtaaacacatttttaaatcggggcctccccagtatgtttaaaacttaaaataataatatattttgaaataaatggttactttcaaaatgacagaactatttcattcaacttaaaattgtaaaatgggtctattattgtaaaatttaccccacctctctttactttatcactgttttctttttgtgtctttgctttgacataagtctaaaaattaaatgcatgtaattccatggttcactgagtattatgccacacaactttgcagcatgtcactagcagtgttattgaccaattaaaggatagcatttaaattttattgtttttgaaggtagggtagctcatcatattttcatttctcttttaattcacttcaaatgaagactttgagattcgtaagtcgtaacataggtgtgttcgaaagagaaggcatttacctagccagctgcatgttactcataacacgtaccatatttcacagtgtgcaaacttcaggagggggaaaaaaggttacaacccttatatgtgaatggggccattatatacttcaaattaagccaatgaagaaatgagaaacaaaagattacagaattgtatagtcttcagtaagcaggcaagtgactccatacagaagagccagtgagccaaacagaaagcataatagaatgtttcttccaaatttctcataacatggacatttctattttattcattttaaataatggagcaacttaaaggctgtgagaaaacaatttcctccacatatgtatgcttttgaaaagttttgctggacatgtagacaattagaacactatagtaatagaaaaatagaatttttttatttagaaatagaatatttttccattctgtgtaatagaaaaaattacacagaattatatatgatatatattacatagtgtgcatgtattaaatatatacttttaaaactaatttttattacaaagcaatatgtgagaagttaaaaacaaccaaataaaaatagtccattacaattacaataattttgtttttgtttttgtaaaatttctgattggtcccttcaaacagagattttccaattttttcaaaaattatattaatagtattacaaaataagattatcagcagatgtatcatttagaataaatgtaataatatatcctatagttattgttagtataacacttaaaagagtttctcagaatttgtaatagcatataaagatagtaatataatgattattatttaatattaatactaatagaatgagtaatagtaagagaatgatagtatttaaattaatagtaatagaatttaatagcacttaaattgatatatttatttcagagctccattcttccaatttaaatttaatttaaattaaaattaattttcaatcaaaatttcctacaaatactatctttatattaaattttaatttgtcagttcaattgattgcagtaataaaaatagtgataataacttaatctggaagaaaaattcatacctagagacttatagtaaatacttaaattcaaaaaataacttaaaaattgtattaaataaaaaatttatgttgtatatgtgaatgtgcacttgtcagttaacaagataatttaagaataaaatatattactataatgtaaacttctgtggaaaaaaagaaaattcaaattcattatgataaaaaggaaactgtcaactttctattaatatatgggcttaattgtattcctcatttaatatgattaaaagactaatgtaacatgtattttaattgtcaatatttgtactagactggaaattgtttatttcaagcatttaaacatacgttaaaatattttgatataaacttggaaatgtatgagggtatataatgttttccaaaattattttatgggatgcacagaactatcttttgaagaccactgataaaacatgttaccaaagtgattggacttaaacaggagataaaattatttcatgggaacaaaaggaaagaaaggaagactagttgcaaatggagctgtggtggatgatgagggaggaaatttaaaaaaaaattgtcttttagctataatgttttcaatgaaatcagaagctgggatgcagggagagcttttattttagtaaaataagtcacagtttggtttagatggttaagagaaaatgaaagaaaagtgtcagcattgggaagatttaaggactactagggactattaaaagattgataaccaatatggtgaaaacttttctgtactgaaaatacaaaaactagctgggcacggtcatgcgtgcctgtaatccctgctactcaggaggctaaggcaggagaatcacttgaacccgggaggcggaggttgccatgagccgagattgcactattgcactccatcctgggtgacaaagtgagaccctgggccccgataccaaaaaaaaaaaaaaagaaaaagaaaaagagaaagaaagagattgttaaggcaaaatgcaatgaaacagcaataacattaatgcatgttttatacaatgtctatcgttttcaggagcagttctgagaaacttaagtttaacccgtgtaacacttagcacacagcctgctaccggagacacctacagcagaatgtaaagacggctgaaatgattcagatacaggtagaattttgcggtgtgtgttttgtgtaatataggacaaattgtacctgattctcttccaaagatttcattaacaaagatgtaaatacttgggctgtgaagtaacgtatagcaaactcgtgcaactgtcattttttgagaacccacaaaagagagacttcagcagcatggtggagttcaagtcagtgaaatgagagaaactgaaaaagggaaagtcatcatagctgagcacctactatgtaccaaacaagacgcaaagtgtttaatgttcattacattatttaattcaaaagtaaccttatgaagtgggtattataattatctgcactttgaaagtgagaaaactgactctcgaaatgttttagtaaattatacagtatcacccaagtattatgaaatagtactatgtctcaacctaagacttctgatatcataagcaaagagaaacaaataaacaaacacgttaaaaagaatcagaataagcgctttttaagacaggtgaaatacagaagtagggaaaattgagatatatattaattatgtattagttaatcctctggaagctggtttcagaacaggcagctgttaactattaatagttcaattgatgagggtgcctttaaagatttttcctcttaagtgtttagaattcaaaattactactgcagagttacagagaaaaaggaacattttctccttccttgatgataagaaatgcattgcattattttagtggctgtcaattaaacacaaattaaaacataagtagtattaaatctgcaaaatcacattcttaattgggatactagcttacttatttaattctcatctctgaaaaacattaattgagatgtataaaaatgtatctgtggtacacagggaagtgagctcttaattgtgaaacgaaatatctctctcattgagtttctctctcttgttaacagacttgatgacaagtagagtactttattaacttcatggatgtgtatgaataaaaccaataattaaaatgctcattcttagaactgacttatttacatgcagttctggctgtcaagcttaacaattattaaattgagaacagtgcatatgaggactgcagtaggattcacaacatgattcaaaaattaccatggattatacagtcatattaagaggcttttggataaaattgagagaggaagattattctggtgatatattttatagcttaatcatgtctgaagagaagtataatcacataataatttacccagcagcagatatattttggaggctattttagagtaagagcaatgtattttctgaagtaatggtacttaaatgtgttttaatattggtatgtccttagaatagagattgaataattgttctattgaaatgtactgttgttgtacaagtgtatacaaagacaaatttttacaaattatagaaaaagagagatgtgtgtttactaatataatatttgataatttgcactctgtatgctaaagtatgttcgtccttgttttcttcacaattattctgtctagatcacatggtcctgaagcaaccagatttcagttcattattctaagataactaaagaagcatttgttaatttccccatgataaaatatacgtaatttgattatctagtgcaagttacagatttaattaatagaataacaaataaatggttttagaacatattgcagatagcttccccttgtctttggggcaatcagctatagcctgactttccactggaattctaagttttaaaactgggttatattgcttagatgttgttatgcatttattttttatttactccattattgttcaatatttttgtagccaggaagctgccagtaccaacttttggccagatgatttaataaatggactaaaagagtgaagctctacttatcctatcacatttttgaataaaacaatattttgaaatgaaacttaacatacatatatttgccaaaaaccactaacggcaaagattaccttttgtatttttaaagctattattaagatctttttaaaactaataaattttataacatgaaaacaattactaattcttgcttttgaaagatataactccagctgaaaggaagtctttcacagatgttctgagaacctcttttgatcatgtgattactttgcaaatattcctggtaagaaacaatagagaatgatttctgtcacctctatgtgatttccataatgtaaagtcttttctgtactttaagaatatctcaaaaaaagaataagcaatttttagctatttaggaaaattaacttttagtttgaatgatgtttgttttaatcactggtgtgttttccaagaaaattcatttattttgtagtgttctcagtacttgtaaaagtattactcatgatttttaaagagcatgtacaattagcaacagaagataaagtatgtggtatctaaaaaaagtacaagcatgatctagaaagcaaatgagaaaacaaaacatacacaagaaagaatattatttaaccagatagattttatatctcattgcttgaagagaaataattgatctaaacaggggttctcaaacttttgagtctagaaatccttaaattcttaacacttattgaggtcaccgtagagtgtttatttatatggattatgtctattgatattttctacttttataattagaaataataatttaaaagtttattaatgtatttaaaataacactaataaacccattaaagtttaacataaataaaatatttttatggaataaaagaatattttataaaatcaaacaaaaattaattagaagagagacaatgtttcacattttataaatctcttcactctctagtttaatatcatacagctgaattcttatctctgctttttatgttttcaaaaatttattaaatactttagacaagaatccatttttatttgttttcttttgagttaggaataaaatggatacttaatatgtatttcatgaatgaatgaatcaatgaaaccatgtattcaggtatattacttttgttttttgaaaatttgagtttaatgcatcttttcattttctttctccttaattacactctcctaatttgatatcagatactaatgtaacaaaagcaaaatagtacctcattgtgcttagttttataaaatacttttactctctgtcagattttaacctgcctgtggaaagagctaagtgagctgagcaggcacaaaataattatctgtagattggtattcatttagcatgaaaaatttattgtgttaaaaaaagattttacatcttaatcacattcccaaataccaggtatcactcttggtatagtgataagaatcgtcttactgtttagcctttgagaacaacaattaattatagagaaaattatcatatatttaaatatattgtcaaacatatgtatcatataacacttatgtaattaggcatcttattcattttattcttaatttttttcaaactgggaatataccaaaagatcatatagtccaaactcttcatttttcgttagaaaattaaatcttaatagaagatgacattttctaatacatttaatcaagataagagaatacttcaagacaaaagtcaattttggtgtttttaaaattttgaacataactttttcacataaaaaatttattcagggattatatctatttggttttttatgtcactcagccaaggaagataaacttatggctgattagtgattttttatttctattagaaatgcaattaatgtctagtaagcttagtacaattgtatttaaaactaaatttaaatttttgtggcatgaatatactgtttattaaattacaattgcactcaagccagaaagtaattctcctgaaactccagctctcagtgcacatacagactaaaactagacttgatgttttctaaattgatgttagaggatttattactccaccttacacctgcacatgtgcagactacagaggcagaaagcttagagagcaaacaagcaaaggtaaatctgcttccttgtcactttatctttccatttgagagtgaaaatttgaactgagggcaatttacaacaccattataacttcatttgcttatgaagtatccttaccaaatatacccaaagaaagatgtatggtagcttatttttaacataacatggaaggtttttcatatgacaaattcatttctattacaaatattttcattgaaatatctcactttattttaaaacacatagtgaagttgttaaattaatctaatgttttttaaaaggttgtcatcttaggttactattgcccattaacatgtactacaaaatacatattaatataatacataaaacattatatgtatctgtatgtcttctaataggccaagagattagataataattactcactattatatagatatttctaaagatgatttatctgaattcactaacatttatttaatccttctttcctatagaaatacaagaatgtttaatcatttgcaacttagacaagattacattttattattccaagatatttgacaaattcttatagataaaaatagtcattcaaagtaatatactattaacttatgtaggcaatacagtttgtgtttctatgtgggcttattatacataatatttatattagaagaatgcccagtcactttaacttttcaagatgtgttttctccagtggattttcagagcatagaaaaatacttaaaataggcatattatggggattctggaaagatggtagagtaacaaacactaggaatctgtctttctacctagtcaacaattccactggcaaaaatctgtctcatgtaactattttgaaaccctagcatctaataaaggcttgcaatttccaggagaaatacttgaaagataaatggtaattgattttggtcaatttcagctctgagcatagtagcagctacacttacccaaccctaaacccctggcaggcagctgcgcacatgttcctggaagagcttgcacacagcctgcagatgccagggcaaaaagaccctgtcctgcaaataccagggatctgtgccctgactgctgattgctattttcaatcatagaagtgtttacaaagagatgggtagccattgtttttgaaccatctcccacagttgcaaacctctccccatctggctgaaataacttttcagggatttaaagggtcagctcataatttttatccaacctttatttttcattttttccccttttgggaaacaggcatttagggctaggatgctcaaaagcatctgcatatgtggagaaacttagaaagtgaccatgcctgcccacagaaagggaaaaaacccagaaaagatgtaaaaagaccttgagtttacacctcaggctgatccttaacatagagataggcaacaactgtcaaaaaagcaaaaacaataaataaacacaatagcaaaacaaaacaaaaacccagcaagcactactgaagggaaagctactgatttctatagttaccacataattaaattcattcaatttttaacaaaaaaatcacaagacatgcaaataaacaaaaaagtataccccattcaaataaaaagtgaacaaaaaagctgttctcaagaagacctgatggcagatctaattgacaaatatcttgaaacaactatcttaaagattctcaaagaactaaaggaagacatggagaaaaacaagaaaatcatgtacaaacaaaatggaaaggtcactaaagagaatgaaaattttaaaagaaactaaaaatattccagagctgaaaaatataataactaaaatgaaaaatttactagaagaattcaaaggcagatttgagcagacataagaaagaattaggtaacttgaagataagacaatgaaaatattaagtctaagaaattggaaaaaatcactgataaaaagttaacagagtctaagggacatgtgtgacaccatcaagtgtagaaacatacacatactgggtgtctcaggaggagagagagaaaaaaaggagatgggaataattgaaaaaataatgtctggaaacttatataagcatccaagaagaccattaaactccaaataagattaattcaaagaaactagcactcaagacacattgtattcatactttcaaaaggcaaaaacaaggaaaaagtcttaaaggcaatgacagagaaacaactcatcacacacaaggaattctcaaaagattatcagctgatttttcatccaaaactatggacatcagaaggcagtgggccaatatatttaaaaatgtaaacaacaacaacaaaagagaaaaaagaaacattgtgaaccaaattcctatatctggcaaaactgtccttcaaaagtaaggaagaaattaatacattcccagataaacaaagctgagggagtttgttgccaccatacctgccctgcaagaaatgatcagagtcctgcaagaaatgctcaagaaagtcttcagggtaaaaaactatacagtaagtaaaagcctcatgaataaataaagtttttaataaaggtaaatacatggtaaattatgaaagccaatattacaaaattagcttgaaaacttttatacttaatttaagagaatagtgcctttaaaataattattaataaatgttttgaggcataaacatgcaaaaatctaattttatacattaagaaccaaaaggacttgggatagagtggtaaaaaagcagatttctgttgttgttattattaaagttaagctgaaattattcaaattagactaatatatatgtttagaattttaaatgtaatctccaagataatcagaaatataatagctatagaaaatacacaaatttaatgagaaaggaatttaaacattgtactataaaaatcaactaaccacaaaagaagacaataatacaggaagtgagggacaagaaaactacaagacaaacagaaaacaaatagcaaaaggttaggattaagttctttattagtaattaccttcaatataaataaactctccaatcaaaagacagattggaagaacagataaaaggacagaattcaactatatgctgtcagcaagagacaccctttagattcaaggacaacagattgaatgcgagaggatggaaaaatttattatatgccagaagtaatcaaaagacagcagagacgactaagctatatcaaacaaaatggactttaaatttaaaaagttataagagacaaagaagaacagtctatattgttgtaagttctaacacagcaagaagccataataattatatatttaaacagctaatatcaaaccatcaaaatatattagcaaaactaacagtattgaagagataaatagtcctgctgtcataattggagacatcaataccccattctcaataatggatagtacatccagagaggagataaagaagaaaatagaggacttaaccaaacaatgcaataaattaactagatctaacacatataaaaacactccactgaacaacacctgcatacacattccttccaagtgtgaatgggacattttatggaatagaaattatgttagttttcagatagagatatcatacatattttcttatgcagctatgacaggatgaagttaggaattaataaaagaagtaaaactgtgaaattcacaaattggtgaaaattaaataacattcataaagaataagtggatcaaataagaaatcacagctgacatttaaaatacttaaagacaaataaaagtattatcataaaaacttgtaggacatagtaagatgagtgataagaggaaaatttatagctatacatgcttacattataacacattgtaaaatacacatttacattctgtcacaatgtaacacaatgtaaaaacacaaaagttgtcaaattaacaacctatatttattacttaagaattagaaaggaagaacaaactaaaaccaaaactagcaaacaaacaaaccaaaaaaaataaaggagcagagctaaataaaaacaaaaacaatagacaaaacaataaaaccaagttagttctttgaaaagttcaaaaacattgacagaactttagctggatgagatggaaaaaaaaaaaaaaagaagcgattgcaaagagaaagttcttgaaggaaattaaaagtgccttttttttttttttttttgagatggattctcacagagtctcactctgctgcccaggctggagaacagtggcttgatctgggctcactgaaagctccgcctcccaggttcacgccattctcctgcctcagcctcccaagtagctgggagtacaggtgcccaccaccacacccggctaattttttgtatttttagtagggatggggtttcactgtgttagtcaggatggtctcgatctcctgacctcgtgagctacccgcctcggcctccaaaagtgctgggagccaccgtgctgggccctctaaaagttcttctttagtgaacatgtgaataataagaaaatacaatagccttattgctgataggaagaaagtttcagtgatcaacccagccataacattctcttcaatgaaagcctaattgagagcaaagctcttgctcttccattctgttaaagctgaataatagagttgaggaaggtgtaaaagaaaagtgggaagctagtagaggtttattcatgtggtttaaggaaagaagccttttccataacttaatagtgtagagtgaagcagcaaatgctgaaggagaagctgcagcaagttatcttgagatatagataactaatgaaggtggtacactgaaaaacaggttttcaatgtaaatgaaacagccttatattggaagaaaacagacatatatatgaagaaaatgccttctatgattttcatagctggagagaagtaactgcttgggttcagagcttcaaatgacaggctgacttttttgttaggtgataaagcagctagtgacattaagttgaagccaatgctcatttacaattctgaaaattctggagccctgaagaattatgcttaatctactctgcctgtgctataaatggaagagcaaagtttgtatgacagcatattggttacagcatggtttattaaatatttcaaatccattgttgagacttactgctcagacaacaagattcctttcaaaatattactgctcattgacaatgtccccgatcacccaagagctctgatggagatgttaaaggagattaatctttttatccctgctaacacagcattcattagacagcccatggatcaaagagtaactttgaatttcaagtctcattatttgagacatgcatttcataaggctctatatctttcatagatagtgattcctctgatggatatggataaagtaaattgaaaagcttgtggaaaaaattcaccatcctaaattccatttagaacatttatgatttataggaatctctcatgaaaggaagagtcaaccaatgtagcaaattttgttgtcttattttagtaaattgacacggcctgctatagtttggctgtgtcttcacccaaatctcatctggaattgtaatccttgtgattcctcgtgagtccagggagggacctagtgggaggtgattggattatgggggcagtttcccccatgctgttcttacgatagtgagttctcatgtgatctgatggttttataagtgtttgacagttcctccttcacatgcttatactctctccagctgccttgtgaagaaggtgcctgcttccgcttctgccatgattgtaggtttcctgaggcctccccagccatgcaaaaatgtgagtcagtgaaacctctttcctttattataaattgcccagtcccgggtatttctttacagcagtttgaaaatggactaacacacagccaccttaactttcagaaaccaccactgtgctcagtcagcaggcatgaatttcaagacccttactagtaaaaagatagtgactcactgaagtttttctttccatgttatagcaataaagtatttttaaattaaagtatatatcatgtttctttacacataatgctttcgtacactacagtatagtgtaaacatagtttttttgttttgctttgttttgttttgtttttttgagacagagtctcgctctgttgctaggctagagtgcagtggcacgatcttggctcactgcaacttctgactacctggtccatgcaattctcctgcctcagcctcttgagtagctgtgattacaagcacgtgccaccacacccagctaatttttgtatttttagtaaagacggagtttcaccatgttggccaggatggtctcaatctcctgacatcatgatctgcctgcctcagcctcccaaactgctgggattacaggtgtgagccaccatgcctggccaacataggttttatgtgtggtgggaaaacaaaaaaattatataactttcttcattgaaatatttgttgtattctggtagtctggaaccaaaccctcaatatcaccaaggtatgcctgtgctttctaactcattatatgaggcctgccataccctgatatcaaagctagacaaaagcactaccagaaaactatagatcaatatgtcttattaacagtgatgtaaaaattttccacaaattactagcaaatcaaattcagcagcatattaaaagattatatgtcagaaacaagtaggatttattcctgaaatgcaagcatggtccaacctacaaaaatcaatgtaatattccacgttaatataatgaaggaagaaaacaaacaaacacaatcatctcatttaatgctgcaaaattatttgacaaaatcaagacactttcatgataagaattatcaacaaattaagaatagagggatggtactttcacagaataaaacccacatataaaaaacccattactgaaaaatatcctataagaacagtgaaaagacaaggatgttcacttttgtcaattttatgcatcatagtagtgggaagagtagctaaagaaattaagcaaaaaataaaaatagaagggattcaacttggaaaggaagaagtaaaattatctctgttcatatacgacataaacttacatgtagaaacccctaaggataccacaaagaaatgcctgttagaactaaaaatttaaatgatggaattaacaggagataaagtcaacttgaaaaattaattttaattgtatataccaacagtgaacaattggaaaacaaaattacaaaacaattcaatttatgatagcatcataaataataaaatacttagaaattaacttaaccaagaaagtgagtcttatacaattaaaattacaaacattactgaaagaaattaaagacaacataaataaatggaaacacattccatgtttataaattggaagactagtatttttacagtgttaatactacccaaagcaatctacagactcagcacaatccatatcaaaatcccaataagattttgtagaaataacctattttaagatttataaggaatctcaagaaatttcaaatagccacaacaatcttgaaaatgaaaggcaaacctggaggactgacacttcctgatttaaaaacttatcacaaaggtatagtaatcaaaacactgtggtactcgcataaagacagacatatagaacaatgaaataaaaaagaaagctcacaaatacgcccttgtgtatttggtcaaatgacttttaacaaggttgtccagcccattcaatgtggaaatgacaggtttttttaccattggtgatgggataaatattcacaggcaaaagaatgatgttagaccatcattcagcaccacattcaaaaattaactcaaaataaatcaaatgcttaaatgtaacacctaaaatataaaactcaggaaaaatacataggacaaaatcaacatgacactgaatttggtgttgatttcttggctataacaacaaagacaaaggcaacaaaagaaaaactagacaaattggatggtatgattattttaaagattatatcaaaggacactattggcctggctctgtggctcacacctgtaatcccagcactttgggaggctgaggggggcagatcacgaggtcaggagttcaagacaagcctggccaaaatggtgaaaccccatctctactataattataaaagttagctgggtatggtggctcatgcctgtaattccagctactcaggaggctgaggcagaagaattgcttgaatcgggacctgggcactgaagtttgcagtaagccatgatggcaccactgcactccaacctgggctatagagtgaggctccatctcaaaaaaaaaaaaaaaaaaaagacactatcaaaagaataaaaagaaaacccacagaacaagagaaaataatttaaaatcatgtatctaataaatattagtattcagaatacaaacagaactcctaaaatgctggaataaaaaataatcaattataaaattggaaagggacttgaactgacatttctccaaagatatacaggtgatcaataagtgcatgaaaagatgttgaacatcaccaagttactaaggaaatccaaatcaaaactacactgtgatagcacttcacacctattagaattgctatgataaaactaaaaataaaaaacaaaacagaaaatataacatattggcaagaacgtggagatattgaaacccttttgtactgttggtgggaatgtaaaattgtatggccacagaattttgaggaattgtatggcaattcctcaaaaaattaaaaatagaattactacatgatccagcaattccacgtccaggtataaacccaaagcaattgataacagggtctgaaaaagatatttgtacacctgtgtttattgcagtgctattaacaatagctgaaacaaggaagcaatccaagtgtccatcaaaggaagaatggataagcagaataaattacacactgaaaaatagttaagatgataaattttgttataggcttttaaccaaaataaaaattttaaaaataatattatgcttcaggtatcttatttgtatctaaaatctttttgaactcattttatggattgaatctcaaagcaaatttatgagtatgagaatatttgcctcatagtgttaatctcttgatttattttaactatcctaaaactaaatttaattaactaaaattagattaatccggcatgattcaacaatattctggttgttttgaaaaatcaagtcaaacctcaaagccaaaagttttccaccactgatttttttaaaatatgatttacaaacatggtgccttaaaagttctaaaatatattgagaattgatcacatatattgacttttataaaactactttcaagagtacaaatgggtttggctacctatttggtttggcataaggattttaacatgatattcaactaaacaaaagcaaaatctatattgaaaactttaatcacaatttcaggaatatagtaagtgctttgtcatctttcttgcttccagagtaattacaaaaaaaaaaaaaaaaaaaaaaaaaaaggactgctaagagaaaaagagaagcatgagaaaaatgtgtatctgcgattccttaattcttctctcactttacctggttatgagatgggaaaaggtacaaagacactccagggagaaaaaggcgccattaaattatgtttaaacttttcaggccatagtctctagtacatatgatcctggtgggtgttaggtaatcacaagggtccctataagagggaagcaggacacaagagaccatagcagatatgatgatggaagcaagaggttgcagttatcattagtcaagaaatgcaagtgtcttctagaagctaaaaaaaagcaaaaaaatagattctcccttcagggtctccagaaggaagcagccctgatgatatattgattttagccctgttcaactcagtttagatattttctttatcaagactgcaggggagtaaacttgtgctagttttagccactgaatttgtggaaatttgctacagcagcaacaagaaaactagtacactgacacttcatagatatttcctgactgctcatgtagactatgatgcccaggatgagaaaacattcagggagtttgatttaaaccctcaaattatataatgcctatggaaactgtttttttttttttttttttcagaaaaatacttgaatttggccttaaaaaatatacacactcaattaaatgtccccatcatcacatataaaaatttcaaagcattaagagttatttatttttttaaaaaagtaattattctggtgaacaattatcaaaagacctgtgaggttattttggtataaattattagagaaaatattaaaaactgattaaggaaaaacatgtcatgagaagatattgatcgagtccagaaaaggaatatgaagaaagctgttaagcagcatgtatgcaattcattttctccttttactgtggaatgaacaaagaaacaacctagtttatttggcaaacaaagaaacaacctagtttatttcaaatagagtgtgaattctttcaaatatttgtgcccaacaatagacggaagagaaagaaatgtgtgacaggtctctggttgaaaatacatcatacatgtctgtaaaattaacgtgttgaaataagaaaataagaaacacacacacgtagcttcaacagtcacgctgtgaactccttctggttccataaaagtttcagataaagtatttttataccttaatgcatacctaatactattacagggaactctattccaccatgcagtacaaagcagaaataagattaattttatgaaaaaaaaacgaaacactaattttagttctatcagtagcactacccctaatggtaatacaaggtttaataaatttcacctctctaaattaatttgctatattaccttctattgatcttttctaatgcaaatatattgctggcaaaatacactggagatttacttgatctctttattgttgtaggacatggcaattaatttttttattgagattccaattagctttctgctcttacaatgttttacctaaatccttctttaaactttccctaaggttaccggaaaaacatcatctaagcatgactgtattaaaaggtagaagtaaggaatgcattacttatgttgtgtacaaaattgaggttactctaggttaaatgaatctgattccttgaagagataaagatgctttaaatcatgaagaactaatcagaaaattctaattgaaaaagaggaccacagtagtctattataaaaggggagaaagtgtcaaattagcacaacagagcagggaaatctgaaagaaattttgcagactgttgccatcatgacccttgtaaaagtgttgttaaagagagaaaaacaaaggaaaaagccctaaggaggcggacttcatgattaggaccacccaaggagagtctctaacaaaagaaaattgagttccataattggaggtggtctgcatgtgaaattttcagatgtgcctgcagacactaagtgcagagtctgagtatcaccaaagggaaactgagagaaaggttagaggatgatattacaaacaccagaacagtgagctgatagacaagagctttcatgtgtagctccatgaccatcctagctagtaccaaccattcaggttaaaaatttaaaactacatgaaaaagctatcctctttctactactgatctacctagcatttactgaccctgagtaagagaaggatgagagagtggctagaaagtaagataaaggtagaacaatcagaaaaggtccctggtatgaacaaataaaaccctactacattcagtgaaacggaatattgcaacccactgaggtcattaggctggatatgggaagagtctcagtttttcaaacacctcaatctcttagctcacagggcttcaaagacagaagggagagaagaggtgtggactatgaaagaccaaggggactcctttttcacacctaaatctctaccctggtgttccaaataacacaaagtgagagacggaaattggattaaattgtaactttgaattcagatttcattcattttatatttctaaatatacaaatactaggcaagtgttgtttgtagtgaaaggcattaaagtttattatttaaacatttacttttgaagaggaaaaaatctgataaaatttagtttctgtgttgccaacagctctttaatgattcctttacatctcttcttctcatataaggtatacagaggttgtggcaatacaaaaactgggtactttgaaccagactgcatattaatcttagatatgattcaaacatcaaagagtaccttacaaaaacattagtatctcacagcagtcaggtatttgccaccattgtcacttaggaattaggtaacaccatatttctatatgtgatcaatacatttagctgattttttgcatatttctaattcatgccagttttattttaatcttgaaaattttctgaagtgctcagattctttcttttctaagtacgagtaaacaatttaatttagcatagtttcaggctgccatataactcatgtaatatttgtagctctctaaaaccgttaagctgagcttagtaataaaaacattcatcaggaaaaaaggatctcacgcaatattagtagtttatgtgtccctggaaaagagacgttttaatttatgtatcttttcattagacaatatttgaagaggaatttaaatagaaaatgtcatgacctagaagatgacctagctcttctttttttcatcatatttttggaaaccattcccataattctcatttcactttgggtagatataatacagcccagtgagagttgtcttatgaatttgttaagtcatggctttagaaataaatcataagttccctgtatttagagtttgtaacaagatctccttaaaaacttaagcgtaatacatagtactagaacttgtgaagacatcttcatttattctcatgggagctttccgttgccacccatgggaggatagggaaactcaacatgtagtataaaaaggtttacctgtattgatgccagagtcctaagaaaacggaaagagaatttggtgcaattttatatggtaaaggtctaaatccaaaaaaaaaaaaaaaaaaagaaaaaaaagctgattgaacagtctctggtgggttacattattgattattgattcaaaagtaaataaactcaacctagtgtaatgcaaagtgttgtatgagtaagaaattaagttgttaacattcttgataaaagaggaaattagtgattgataaatacttattttcctcagtcctcattctcatagtaattactgtggaatgagatagtgtgtctctcaacttgagaaccttgcaatccagaagtaagactacgtacaaacacaaaatacacacaaatgaaaacaaacatacatgatttactctgcagatttaagtataatgcaatttaggccacaaaaataattgggcagaaatatttcaagtaattttttgtccaggaatgtacctggaatggttacatgtaggaaatggcatataacatttttaaaaaaggcaaagaaatgatttgaagcaaaatgttacacttaggaaaaatattactgatgatgtttagattacaataaaggacaaagataatttattgcttaaaacccaatactgaaggatattgaaccgtaagggtgactaacatagctgactaggaagaagcattaaaatcatgaattaagaattttttggaggcaactgggagtcactccagaattccaaaagaagaatgacagttgatatataagcacttacgtgcacaagccaagagggtgctatcacgctttttccctaggccaccctgcaggagcagtttataagtcttgggttacagtatcctagaattttgaggctccctcccaataaaaattgagctctctgtgcagccaagggacttggggtccatcagtaagaggaccatgtctcaggactaaatagaaagccaaaggaaggcatgaaggaggaaggtctacatgtagttccgttcaataaaccttcacaagagattagaaagaataccacaaagacactactgacctaaaggtctttgatttcacagagtaaaatctttttgagaagatcgctattattaagtggctcaggtgaacacagatctgactgcatgcctgcaaaaaaactgtcacagagatgtctctatactgaatgccagagtgggttagagaacacgcctctggctatgtcaacagagattattcacctttcccacaacggtagtacaatcaagtcagtcgatctcatcttcatgagactctggatctacagccatcatttctaaaacaaatgcaaacgaaggtatattttggggtgagcaaaggagctttctctgtgtggggtatcatgtctgggaaacctgacgttgtttgtgtagaaggctcataaagttcctgtaaagaattctgatcaagactccgaaaatttatctggaagagaatcttaattcgccatcaagaagacattcctttttatggttcaaatgatgaaatggacactaaggaaattttccatttttgcagaaaaagtattctgtgttaatggaaccggaggaaaccacatggctttggtcagctgcatcagttcttaaatgccagagaatgtgcagatgttttccaaatgttctttaatatggaaggacaatgagcagaaaagtagttgaacatatcttgtcattgttgaccttttgattttgttttcccactctttcttgaaagagtgagtaattttattttattttattttcattctagaatgtgggggaaggggcaggcaggaaaagtagtataactgaaatgcacctgttacaaatatatcatgattgaaagcagaactgaatttcaaattataaccctaaaattgatgttagacatttctcgacatatgaactatgcattttgaaagagaattaattatctatgaaggtaatgttggtggtctaatttgccagccattcccactctgcttctcccttccctgcctccactaaagaatctagaaaagctaactgctccttttgcaccctctgttgcaactatgaatggctttgggaacacagctttggcttcaggatttctgggaaaacttttgcttcctcattaaagttatatatgcagctaggtcatctcttcttcctctgtctgccataaacaccgaagtgatgtctgaagctagagtagtccttttaaccaaagggaaggaagggctagagaatcacaaagatgtcagttcccccattgttgagctgctgatggaacaccagaccctgcctatctctggacatcttattaaatcaaccagttttatttaatttctaggcttttaaatagaagttgaaagctagttatcagagttttacaaagctttagtattctatttaccccagccatctgatatacaaacaagtgaagttttcctttttttttttttttttgagatcgagtcttgctctgttgcctaggctggagtacagtggcgtgatctcggctcactgcaagctccacctcccgggttcacgccattctcctgactcagcctcccgagtagctgggactacaggcacgtgccaccacgcccagctatttttgtatttttagtagagacagggtttcactgtgttagcccggatggtctcgatctcctgacctcgtgatccacccgcctcggcctcccgaagtttttcttaaatagagtttgcagtttgtctctgtttctgtgtactcctgcctctgcccttgctcctaggcttgccttgcccatgctgaggcaagtagagcttgaacatttttaataggactccacaattcgtcacattagtaatttagaaaatgtgtttttgaggaattgtattttgatactcttttcattctggaaatagctttttgtgcatttatttttgcagaaagatctagcatcaaaaaaagtcactatctggtttttggggccctccataaatcagttccaaaagcatttatcaactatttaccaactgccagaaaaaacaaacaaccacttatacctgataattcttattactgtatgttgatgctttaggaaataaataataaagatgccatctataactaaaagttttaagagtacaaaaggaaatagtttgagactgtatgacaagagaagactaaatatgaagttccctaattgctggctcaaacttttaattggatagatacattacatatctaaaagatacatacatatgtatatatcccatctaaagtatgtaataaaacattgaatataaaatataaaagaaaagctaaaaaataataattttatactttagataaaacttagaattataatgtgaagataaatttgagaaagtattcagaatctcctcagttattacaaataatgactataaatgctgatatctcaccatacatttttggtggtgtgggatcgtcaaaacagtgagataactatagtagagcagatattatgaggattcccaggagcactaaatattgtaactccattttgtatttagtcgcaagcatttatattaaaacttaagggtctctaattagaatacaataagaaaagaactataatgtaagagaaaatctttgtacaagatggttgttgagaaatctcactgtaacaaacataataaggctgtaaaagtagtcaaaatatgtatttttaaatttgaaagtatgcagtttgcaattcttctgtaataatcataaaagtatctagtattattgttttgtaatattataaagtaaaaattcctttggggaactagacactttatttcatggaatatactaaaaatattgttttgaaatttcaataaatgttttaaccgatggacatgtaattggcttgggattaaaactatgaaataatatacttttttttatgccttcatctataacttgttacagacttttcaaatgtttgactacattatacaataagtgagaagagttgcaattataaaaagaaaatgcattctttaagaatgttctctgtaattaataggtgtattatctctcaaatttatggttttaacatttatgttgaaaattaatttaaatatctttatcttaaaagtgtaatttttaagacagtataaaaaattaccttctaaggaagttgtatatgaatcacatgtgttacttctttcaaagtacattctacaattatacagtaattctctgagtgggaatggaataaagaaataactatatgttggtattgggtgactttttgttttggtttggtgatttaagttgttttattaagtatataaatttcatataccttaagtttggatagccatgtcttaggtcaagaacttcatataatttattagatatcaaagcatggggaaaattataaaactatagaaactaaagatttaaaactatttaagaaggaaagaaagtggaaagcccagaacaaaacttatttgtgctttcctctcttaatgttttgacatatgtattgaatctgttatctgaaaagaataaactcttattttctattttatcaacacataataggagagaaccctccttgagactatcttggatcagaagattatattttgagatctagagtaagtaatcaacacaggacaggccatatgattcatgacaaacaaaaggtaatacaaggaagcaccaaaaatgcaagtacggcataaggctagagacatggtattgacatcatactaacaactaggcaagactgatgattaagccaattaaaatgtacatgtcctcatttctttttcttgacaaatgtttattgagcatttgcaatagctagacatctatgtggatgttacacatgcattagtaagtactttacttaatttatgtgtatcttgatcaaaccaatgagcttccataagcttattttaggggtataggttaaataaatttggagcttaacaaatccatgtgaccagcataatgtaaagattgtaaaggaaatccatgcacttgagtactgttcttgtcttaattaaccatatgaactctgaaccttatcagagcttagttatgacaaggacataacttgcttaccaacattctcatctggtaagcaagagggagaaatgaaggctgtttagtggcacttggctggaaagacagatgtgacatggctgttaccaatctacaaagaggggtttccagggctttgccttctctgtctctgcctctgtctagggtcttctgatactccacactagatatcttgatcacattgcttcctatttcctgagacttccagtccctcataaaataaaatcatccaagtcctagttactacaggaaaatacaaaatgagtcatgtaattgtaatgcttctgctgattataaagttctgcagtttattgaacaaaccacaactcaaaaatcaagccacaccaaagaaacacaaacaggaaaaataataaagtattttaggaagcaacttaagttgtttatgagtttccaagacactagtcacagtatatgttagtattagatttcaacaaaaaaaggagacttaccagaaaactgctgtaaaagagtaatcatttctatatgttctggaggataattaatctgtcttggagcttttatcctcaatattttattgtgaaaatttttatacatggagaaaagttgaaaagatttatgcaataaaaactccatatactcaccagccagattttaccatgctttcttattatgtatccacttattcttattatgtatccattacccatcaccctagccattcattactccttattttttgttacatttcaaatttcagacatcaatagatttcctcctaaatacttcagtacgcataccatcacatagtttagtatttgtttatagtttttcttttgatataaggtttatacacaatgaaatggacaaatattaactgcttattcactaagttaacaaatgcacccacgtgtcttaaaagttgtaataaacaactgaaggaggtaaattttacattgttagtattaggaaagagactaatactagttaaaaaaaaaaaagcttaagaaacagcaccccaagattcaaattctacccaagaaataactgtaaaggaatattcttatatttctctgaaactatttaattaacatgacataaaaggaaagttactggggaataggagaatggaatacttgtgcttattgacctgattaccaaaaaggcagcagtaatgaggagagacattgaaatacatgagcttctcaaattaagaacaaaatgtttttcaacttgcaaaataaaataaccttttggaaaaaatcctccagataacacagaatcattcctgaacttcaaaacagttcaactttgccagaattagaaactaagttaccaatgtgtgatatgtgtctaaggaggatgataaaaaacattgaattcttttaactttatagtataacttggaagcaattcagagttttccattaagaaaatgaattaagtgatgctattacaatctgaattacctttatttcattattttatattagatatcagcaattttaatgtttttaagaaatgtttgaagaactatgaagaaaaaaataaattaattattcaacacgtacgctatatgctgtgatgagacaggagctagttaaaatcagtaaataatcctattccaacagggaagtttggaaggcacatattcatttctggtccatagcaattctgaaatctaaccagaagcatgttgtcaggttcttctactaaaggggcaggggatgtttctttctgattgctggaagtgcttccctaagtagtttttcctttgtggcccttgcctcaactttttggacttattgggcttccctctgagattccatttcttttctgttcagaaattacatatatttgcaaatgagccactttctcagactacatcctgcccaatgaaattcttccttttgagacttcagagaccacttcattttgaacaattgctgcttttttcagtctatgctggaagttcttggcagtacaactctgtttaaaatttttagtttcctgtagttcttatggtagttcaatttatgacccaaatatcatattcttaattcattttgaaacaaatatctctaatttgagtgtgtttagagacccttttgtacaactagtagggtctcagagacttcccaaaatcattctgaggtctttaataaagagattttatggtcacacaattgatttgccatgaggttattatttatttattaatttttgagaattttttccttgctaaaagtactagagatgctagcaactcctaactcctctactttttctctaattatttccttaattataatccccagttgtaaacactaatttctgtattaattgtatgtgtttgcctaaaggccacagagaaaaatcgaattaggaaggaactcacagaaatcagaaagtaacatccctgtcccttgagaagaacctgacaacatgctccttgttggacttcagaattgctatggaccagaaaccgatgtgtgccttccaatcctttccctttgaatagctaatgtatttgctcgtatcttttcatacatgactaaaagaagttgattgagccttttaatattatccctaaaaggcaaggtccacgtgttcattaggtatgttttacagcttcccagttactgcaaatgatgttttgataattgcttttaaactatatgagacaccatttttccagtgtctaacagcagtttactcataggtttcgcaagaaccattatccattgtttatttttcttatcttcaccaactatttcttgttttttctcagtgtccatcgtcttcccaattccacagactatgccgtatgtcttagatttttgttatagttcccaattctcgccattaatttcttttttttatctgttctgatgatctttgtcttttaattggtgtgtttagaccattgatatttaaagtggttacagatacagttggattaatatcaaccatatttgttactgttttctatctgttgctcttgttttttgttactatttttgtctttcactttttctgccttttgtagttttaattgagcattttgtatgatttcattttcttactcaactaatctaagtccacttccaaacaacattatactgtttcacagttagtgtgagtctcctataataacaaaaaatcctaattcctccctcctgtcccttgtgtcattgctgtcattaatttttcttacacataaatctacatcagtgtatatatatatgcacaagcagtagagacagggtttcaccatgttggccagactggtcttgaactcctgacctcaggtgatctgcccactttggcttctaagtgctgggattacaggtgtgagccaccgcaaccagccaaactttcagttttcttacttttagttgacctaatagacaatagtttgtctaaaataataatagcaataacagattttatctcgccattaatttctgtagtgattatatgtttctgccttgaaaactatttccaaacacagagatctaaaaccaacacttacttaattataattctgaggcttcgcactttgatgggggttcacatgagatgcctcgttctcccagggtgttgattgggctcttcatgtgtttggttttctaacagaatgatgatatagttggaagcaccagagcacttcatcagatgccgtcatcttccaggagcctatttttcacataataacggaagaattttcagaaacaagagagcaagcacttaaaccgtaaatacaaggattttcaattatttgcttgtcatacatgctaatatcccagtggccaagaaaaatctcatgaccaagcccagagtcaacatggaagggaacacaagaacatggatataggagatgggattcattgagaactattagcgtaacaaattgccacagatagcattcaaacatggcataggccaaaggcagcaattaatcataagatgcaagtatattatatttattttaataggcaatagatatacatgattaccatggtgtctcaggttaagtacaaatttataactctttgataatttacttcttattaaattagaccatctcacaatcatcatgttccacagtattgatgacaacttgcttagaagcttcagtgatcaaggaagaaggaggtattctccatacattggtaagaaatatacgtgccagaaagtagaaaataaacattagaaatattcagagtttcgttatctcattgaattttgtggaggtacaaagtcaacccattctgttaaaagttaaagatgaatttctgccagttatgatggctgctactaagaaatagttacatcatttttttttttctgagatagaatttcactcttgttccctatgctggagtgcaatgacgcgatcttggctcaccgcaacctccgcctcccaggttcaagcaattctcctgcctcagcctaccaagtagctgggattagagacatgcatcatcacgcccagctaatttttttatttttagtagagacggggtttctccatattggtcaggctggtcttgaactcccaacctcaggtgatctgccgtcttggcctcccaaagtgctgggattataggcatgagccactgtgcccagcctgctgggactttttagatttttgatttgacatttaccatattgatcatgttgctcctctacatctactgaggaacctgtctggctgcctgcttcaagtggtttccagaatggaagaattctggctttttcaattgcaggagaagctgaactatcacctgaaatttagattcagttctcagcaaatactgtctcagatcatactatcagtgcaagggttataagcataatagtgcctgtcctatgcccccatagaagaaacagaatagagtgttttgctgaaatgtaacattctctttggccaaaaaaaaaaaaaaaaaaaaaaaaaattattcaaactttgaaaaaacagttctttgctgagtcgtataagaaagtaagaaagatctgactatagtacacagagtgaaaacttgagctcaccagccaaaaatgatgtaaataatatcttgtctttcaagtcatacagctgtgtgtatcctgtagaattctatcactatgtaaaagtggcatgataaagttacaggagatcctgacagtagagtaacagcacaagaacattgcatttgctgctcatatttgcattataccaatttcttcttatagcctcagaaagtgctttatatgatgtttgtccaaaaagaagatattcatgtctcatgtaaggatagatatgcaaaaaaattctgctactagtcagaagtagaagagaatatcattatctaggagaagcactaaagacaattaggggaggaaaattatcctggcaggcagaactgaatgcctataaagttgtttaccatgcttggaaagatatatgaacatagatatatttctagcttttttatactcagtcaccaacaaacatcagattgcaggatgtcgaggaacttggaagaaacaagattgaaagattggtcacaaggagcccttaaatggaggtgtgtacaaggccctctcagaatgcacccagactttggcactatttctaagttatgtgaatgcttaacaagagatccatcaagaagaaatgactgctccagtaaataaaaagatttagttatttatcatgctaacaaatatacttggttgctctatgccagagcatgatgttatcatggattcagtatttgtttcttctgttggaaaattaagcagtatgcaggaatacaggccagatctggctttttttgtgtgtgaagaggaacccatgttgttgagcttatacatcatatccatatctaccagtgtggccacttcattcatgagctctttgagtgaatactgttatggtttcaacaaatggctcatgcaaatccttagcgcaatttacattttctattttatttttaaattgtttcgctaggggagcactttgaacatagactagacattagattatattgagaaattattttttaaatttgaatagataataatgaaattctggctatactaaaaagaaaaaatatcttaattgttagagatacgtactgaattatttaagtataaaatagttttcttgaatttgcctaaaaattctccagcataaaatagacaaaaacagaattggttaaattgcattaatttttgcaacttagaaataaatgcaaaggggaataaatactattctctctagttgtggctatgtatgaaaaaatataaaatatatttttaaaaggctgggtgtggtagctcatgcctgtaatcccaaccctttaggaggccaagggaggagcattgcttgaggccaggagcttgagacaagcctgagcaatgtagtgagacctcatctctgtacaaatgcttaaaaaattagctggacatggtggttcatgcatatagtcaaagattcttggaaggctgaggcaggagaatcacttgagcccagaagtttggtattgcagtgaccaatgatatgctactggcactccaggttgggtaagattgagaccttatctataaaaaaaattaaaagaaaagtactccataaaatataatagtatagtatgaggatgtaaaacaaccattttattttgttttatcattttttattataaatgggcaatttataattgtatatacttatggggtagaaagtgatattatgatttatgaatataacctggaataattaaattgagctaattagcatattcatcacctcaaatacttatcttttttgtgatgagaacatttgaaatttactgtcatagtagtccctatgcaaccattctgtttttcactttcagccaagtattcagtaagttatgggaggtattcaacactttattataaaataggctttctgttagatggttttgtccaattgtaggctaatgtaattgttctgagaatatttaatgtaggctagaatgagccatgctgctaagtaggttaggtgtgttaaatgcatgtttaacttacaatatctttaacttatgatgggtttatcgggggcatccataatactgtctttgatgtttgaggcacctccatacaattttctaatgactaaactaatttaaattcccaccaacagtgtaaaagagttgtcttttctccacatccttgccagaacatatttttcatcttttttatagtagccattctgcaggtaagagatggtatgtcattgtgattttaatttgcattttcctaatgattagcaatgttgggcattttgccatgtctgttgactatatgtcttctttttagagatgctttttattatttccttactgttgaattgttttagttccttgtatattttggggattaacttgttgccagatgtatggcttgcaaatattttctcccaattcctaatttgtctttttcacactattaattgttttatttgccatgcagaagcttttcagttcaatgtaatcatttgttgattcttgacttgatttcctatacttttggggtcaaaccccccaaaatattgcccaaactaatgtcatgtagtttttttcgttatgttttcttctagtggttctacagtttctgaacttatgtttaagtctttaatccattgtgagttgatttttgtgtgtggtgtgagataagggtccagttttattcttctgcatgtgggtatccagttttcccaacaccatttattgaagagattatcctttttgtactgtgtattcttggatttttgtcaaaaattaatggactatacatgtgttctttattcatttccaggttttctattctgttccatagtttatgtgtcttcagttatttatttttctgccactactatgctgatataattactatagtttaaaattagatcgtgtgatttcttagctttgttattggttgtacataattgcctcggttatttgggtttcattgtggtttcatatacatttagaatctttttatttcgatgaaaaatcacattgcaattttgatagaactttcactgaatctgaagaggactttgtgtagtatgaacattagaatattacatcttccagtccataaacatggggtatcttttcatgtattagtgtcttcagtttctttcaccagttttttacagtttttactgtagaattattttacttcccaagttaagtttattcctaagtatttcactttttgtagctactgtaaatggaattgttctcttgatttcatttgcggacagtttcttgttagtgtatagaaactactgattttggtgagtatttttgtatttttcaacttacctctatagtgaggtaaattatgtactagttttaatagtttttatgtggggtctttagggttttctgtatgtaagaagtgacgttttggccagatgcagtggctcacacctgtaattacagcactttgggaggctggaggcagatatatggcttgagcccaggaacatgagaccagcctaggcaacatggcaaaaccctgtctaccaaaaaatacaaaaattatctgggcatcatggagcacacctttagtctcagctactagggaagctgaggcaggaggataacctgagcctgggaggttgcagttgcagtgagtcctgatggtgcaactgcactccagcctagatgacacggtgagaccctgtctcaaaaaaaaaaaaaaaaaaaaaaaaaaagtgatggttcttgttttcccatttaaatgtcttttattttctaaatttttattaattggtctggcaagaatgtccaataccatgttgaataaaactgtcaagagatggcattcctgtatttttccagatctttgaggaaaggctttcaaatttttaccattgaatatactgttaactgtggccttctcatatatggtctttattatgtgtaggtaaagaggttttttaaaaattattacgatgaaaggatgttcaattttttaagtgcctttctgcatctaatgaaataatcatataatttttgtctttcattctggcaatgtgatatatcagatttattgatttgcacatggtgaatcatccttgcatctcagggaaaaatctcacttgatcatggtagatgatacttttaatgtatcattgaatttggtttgctagtgttttgttgaggatttgtgcacctatgctcaccaaggttgttggcctgtattttttttttcttgtaatgtccttgtctggcttttctatcagggaaatgctagatttgtaaaatgagtttggaagtattccttcttcattttttttggaagattttgagatgcattggtattagtaattctttcaatgtttggtagaattcagcagtgaaaccatcaagccatcagattctcttttatttaaatttttttttttcatgggagactttctgttactgattaattcttcttactattttttgtcctgttaagattttctatttttttatgattaagtcttgttgggtagtatgtgtctaaaaatttatccatttcttctaggttatccaatttgttggcataatagtattttatgatcctttatatttctataaaatcaattgtaatgcctcctttttcatttccaattttatttatttgattcttatcaatttttcttctttagtttagctaaacggctgccaattttgttgaccatttcaactgaccaaatttggttccattgattttctctattgtttttctgttcttctctattttatctgttgtgctctatgttctattatgttctgccttctgctaacttcgtacttagtttgttctttctctagttttttgaggagtaacattatttatttaaaatttttcttattttttgatgtaggtgtttattgctataaacttttatcttaaaattgctttgtgctatatcacataagtgtttgtatgttttgtttctatttttgtttttcttgagatgtttttaaatttcccttttaatttctacactggtccattggtttttcaggagcatgttgttcaattttatgtatttgtgaatttatcaaaatttcccattattgatatctagtttcataccattacagtcagaaaatatattgatatgtttccaatgctattaaatttgtgaagatttgttctgtgtcccaacatgtgacctggcctggagaatgtttcatgtgcacttgatgttgctgtattctgttgctgttgaatggaatgtcctgtatatgtctgttaggttaatgtggtttaaagtgttcaaatttaatgcttccttattaatttgtacggatgatttgtccaatattgaaagcagggtattgaatcccctcctattattgtattgcaatatatatctctctcatcagatatacatatatatataaaataaatataatatttattttataaacaatcattttcaaaatcaaactgagtgagcaggtgattttacaaatgcctatttgatttataattcaataaaatagtagttattatagaaacattaaatactgtatttttttcatacatatcaaggaggaaaaaatgagcccagactgaaaagaaatgtattattaaatacaaaaggtctatattttacattgggacaatatgacgcttgtgttgaattgcaatgtttttctgttctcttactcatatctcaaatggccagatcagtttttccccttgaacttggattagcatatactgtcatattaatgagcacatacattttatgtacatttatattttaattatatattactaaaagaaaaaacttcactcaacattattttcttctgccaacaatggtaatgtgcaggtacattttgataataattatttttctcatagttatctcttttatatttatcttgctttacaggcaatattttgtaagtgaaattcaataatgctattactttaattaatatacaagtcttatcacgaaacttttgcttagccttgaaagatttagatataatatttagcaaatgtgaatattttatatagaaatgacaaaaataatttggtcattttttcttagattttttaagattattgttgacatattgtgtgtgtatattctgcattttggagaagctcataatttcataatgagaaacaataaaattaaatccggctttttgcaatttaagcaaacaaagaacaatgacattattttctttatcagcccaagtgagctattatggtgggagtggagaattggtcgaggtaatcaggaacttactttcgcatagctgcaaaaattttatagtaacttttgtttctcttatttcttccttgaatgaactgttaacaaccagaatcacttccacaaccaaagaatggaaatgaacatgaattattaattctatctgaaaagatttagatgccttttaacaatctgttaattttacagtcaagattcaatctttcaataattctaatgtcatcagagagaaagaaaacctttctgggaaaacttcaaagtaagtttcatcacttggaagtacaatacaaggaaaaaataccaaagtattaataaaatattgcccgggcgcggtggctcacgcctgtatgtcagcacattgggaggctgcgggggacggattacctgaggtcaagagtttgagaccagcctggccaacatggtgaaaccttgtctctactaaaaatacaaaaattagccgagcatggtgttgggtgcctggaatcccagctacttgggaggctgaagcaggaaaatcactcgaacctgggaggcggaggttttagtaaaccgagattgcgccactgcactccagtctgggtgacagagtgagattccatctacaaaataaaaaataaaaataaaaataaaaaagtattaatacttatgattaaacttttaaaaatgttaggactggtagagaactatgaggtatatattattatatgagtatattctcataatgtcatgtttagagtatctttaaaactcaattctgtcatttaagaaaatagtaataatagaaacagttctagaaatatttcttatatttgaatcacttgcatcaattaatcaatttcttaaacttaaaatgatttaataacgatgtgttgcttagcattacatttcactttactttctatttttctttgatttatgtcattatgattccttataagagtccatgtcttgcctttcctgcttctcttttcattaacgtcattttaatactacccagatggaaaactcaacatcattcagtccctccagcttctgtcacttccagccagtattcaccagtcacaaggcttgttcttttgttctgcaacatatttcttcaattttcctgtgcttttaaaacctccttggctagaagccttgttcattccctactgagataagagctgatgctgaatgtaacttaaatctgggttttttaagtctctaacaattccatttgcatttatcctctcttgacaacactcaaaccattctgtctccttgtccttgtcagaaacgttcccaatgcctatgcctgcctcagatggctttcaacttgtgactacttaccatgactaccgtcccttcccagaatgtttgtctatctgaacaaccgagcagttccatgtgactgacctagaaagttattcaataacaagcatagctcctgaaactgaatatttggcaactaaatactttctttgccacctaaaccacagaaggtttttgtttgttttttatggtcctttctcaaggtttctgttaccttgggtcacatttactctttatttttattttaatgtgcatgccatttttttctgtgctaccaatgcctctttcagtggatctaagcctttgtcattctcatgctagttttagtaattttctctaaagtaccatactataatactaaaatatgttccatcagtttgggtttctgaataactatttaaagaattcttaattgaaaactaggtgaattaaataggatatgtgtttattttacaatgaaagggaaaatttgtttttactccctgaatagatagtattgaatagagtaaaaagtgcatgtatgcatatgcataatgttggattttcattgttatagcacaggcagagaaattcacatattatttttctaatatcactgtgatatttgagtaaatgcaattgtccatagaaaaatgtacatgttcttgaatttagttttgcatgttttttctgtgttctttgcatcctctaatttatacaccaaaaacaatcatcatgctctttagtatccttatatctgctaccttcgctagtataaaatacttgaagttagaaaaaaaaatttgctttttttttgttatttgtctgcttcaccttttcattctaatgtagtagaatacttagcatgtggaaaatgtctatatatatttgtcacctgaatgaatgcatgtgtgaataaagattagtctagtttttcctctgctgagactagatataatttctggattatatgattgcagtttgaaattacagaaaccagaaaaccaaattgtatatgagttttcatatggggcatttaattgtcactttaatctcacatgtttttgtttctttatgtttttaatcaagaaaggatattacatagcttagaaaattctagaatgaacatttatttttctcccaattttattacctttaatgccgttttccagagccagctattttaccagatttatttattttagtctttacctccatatctttgactactatgcatgtacttctagatattgatttatacactttcaatcttacctattattttctgttttgataggtgagatttaccacatttacaaaacctggtatatttagtctctccttttcctcaaaatagctatgattgtttcagttcttccattggtcatcactaaaacttcaaatcagatattattatttctgctcttgatcaatctgctatggactaaaatataccatattcctgtgattttctgagccatcaattttgctttctattttactgagtcccttatataatattgaagcctttgtaaaatttgtcacttatgttccaaacggtgatgcttgatctctcatcccgtcacccagctgagatctgaggtctaccttctctctttttgtagagccatatttctggaatttcatatgtaatccttggtttatgcagttttttgagaataccctgaaataattctctgaaaatgtaatgtagagaagacaagataaattttgtcttcttacacctctgaaaatgtttttattctgttcttacacttgattattaaaatacaattctaggcttaaagcaaatctctatgtcaattgtgaacaccttatacattttctagcattcactgttactgatgagattttgacacctgtcttattctcattattttgcaatacacattttttccctgtaaatatcttgagaatgtttctttagcttaatataatatttcacaataatttttactagggacgaggtgtttaggcattaaataaaatagattcatttaattaagggctctagctatttggcttggaaaaacaaggtatgatatacagtgattgtataaattttaatccaagttgaaatattttaagagtaagaagaaatactattaataaatatgctaggataaccgagtcaaccagggctgtcccaagcaaagcagaatatatgttttccctaattacaagatacatgaatgttacctattcatatttgaagatttattataaaagcaaaatgaataaatagcagtaatttaagatttaagatgctacttgtttgaatttttttctctctctctttttttttacttctcttccaggggtctttagttaggtgcttatatcttagattgctttttatcatttattttcttacattttctgtctccagggttttgtacataatttagtgaacagtgaggaagaattgatgggtttgaagcaggtagtgaattttttactggtgtgtttgggtattattgtaatttacataataatgatgtatataagatggattggagcaggtagcaaatatgcatcactcaaacaaatatgataaaattataaatttaggtagaagcagcaggattaaagagacaattcaaacgagtcatcttgggatatagcagataatactcagaaaaaaagtttcaaggggctaccaaacattgttacagaaagaacattcaccttgcaatcaggaagatcagagtttaattttttatactatcaatatctagcttcacattttcatataaatgaaataaaaacattcagaaaaaaattatagtactttatgggtttctcttcatattaatttccctctttcccttttctatgacaagcactttcaatatttcattttaatctttttagtcaattaattttcataactattgattctacatataaaaaacataaaaattctgtgcatttttatttatgcaaatgacacatgtatgtgttattctgtgtgttgcttttagtattcaatttcagacctttgggaaccatccacattgatatctacagatctactcttattcattttagtgttggatattattgcctattgctctatatcatttatccatctcccattgatgtgcattcatgttgtttccagacttcaaattcacaaaaaatgcttccccaagtttcccttcttgcaagagtaaggcacttattcctagtctcctgagagggctattggccaactacctccacataggtccctctcttagatttgccagcaggtgaagagagatttctcacccaagaatatgttccattctcatgactggtgagtgcaggaccaactcattgcagactattctaaaaagcctcccatttctagatcacagtaaaacttttctctctgcataattcaacttgctttctttacctactgatgttgatactgataccactccccaacaaatgctgcacacaaatcttcctcagagttattttcagggaatataaataaactccatcagttagcactagaaatagtttgagaaaccacactcaaaaaaaggttttcgtgctagatcatctattatcttcctggtaacagagccctcatcacttgtggtagatggagaacatgtagccttcaggatgtgcagcagatccaattgttaaaattttagtgtggcaatttattaggcaatttattaggcatttgaggaatactggaaaaaataaggactgtagaatccagtagctctaacttaagactgttaatgatgaattagaaaaaaaaaaataaaaggaagagggtgatcaatcaccctttacagcaaaaaagtgaacaccagaaggtttccttgataacacacaaagagaatttcaacttctgctatcagaggtcagaaaaaagcttcagattaaattcaggacctgcttgtaaggctagttttactccagagaaagttgaagtctcaatactgacaatcctgttacatcaaagtgagaacttagattaggaaaagatggaattattaggcatgggatagaaatgctgggtccttgaaataaaaaaattttaggatttcctgtccattagaggctactgatcctaccttccttgaggatgacaaagatttctctatctttcaagacaatggtgtttttctcctagcatttcatacaattcttcttgtctaccatatcaatgacaaagattaggtcataatataacacattctggtaaactctgggtttgccaagagaaaaaaggctatatcctaataaatctgtgttatcttgccaaaatactttaccaggaggcagaaaagtgtatatgggactggagaggcatcacataaagtttggcaaaggagagtttatcaatataaaaaccttctgtaatatagaatttaacatccaacctagcaagaaaatctagaagactgcacttaaaaatatgttagaatgactattataagcttggagaattttccagcccatagtatatgatgcagaaataccaaatttatcaggagagatgttaaaggatgaaatattaagttgatgcaaaagtaattgtggtttttgccactaaaagcaatgcagtttttgccatatagttagatgcttatatcctggattgctttttgtcatctatttttttatatacatgcacaccaacctaatgggaagtctgaaagtggatatgctaaagtagatatactacatacaataagaaaactcaccagataaatatgatgcatgagtggtccacaaagacaccttatttattaaggcaataataaatgtgctggtaatctgaactctaaagacatcagtggaaaatgtgttctatagttcacagctgacagtaagatgtatcattatagcacctctgatggcaatggaattagcaagatcctgaagtaataaaatccaaattgtcttaactcagaagtagaaagaaggcaaaactattatgataagcttgcaaagttcagagtttcaaacagggcatcactacctgtaaagaacagaagctattgttaatagaatagcatccctaagagcaaaatagatgagaagctgacaagaatatggttcaaaagaactaaagaatgaataatcaggaggcaatctcttcaaatcaacacttattcttttgccaatttctgcatgtgagctagttttcagacctggaacctattgaatgtaagaaacttggtcccaaaatacagggatcacataacatcatgtaaggatatttcacatcaagttctcaatcttttccaaagatgtgtatgactttttattttggtagtcatttcctaaaagagagaaatacctaatctttgaaggactattgacacaggttccaaattaactttgacaccagacaattcatgacattttatgaatttttgtgaatggatgtatacgggaagtaggtaataagcagagtctgtgatcaggtttggttcatagtgtgcaatgggtctacggaacccctgatggtaatttctctgattgccaaatgtataattgaagtgaatatactcaataaatggtcaacacatcccattgttttttggtctctaagatatgagctgtcataggtgaagataaatggaagtctctgaaactacctcccttccattcacaaagagactaaatcaaaaccataccattccatatcctgaggaaatagtgatgattaatgcccaacttaaagaccaataagtgtcattaaatccacaaacataacccatcaaaaaaccacataaatgctaacagatgatcacgagttactgcaaactcaatctgcagctcctattgcagttggtatggtagaggtgatacctttgctacagcagattaatacagcataagacacttgatatgtagctagtgatctgatagatgtatttattttcattactattagaaagaaaatccagaaataattttctgttacttgacacagactacagtctgtcctgatttagtttcatggtcttgccccaagaatatgttaactttcctgtcctctgtcacaatataattcgaagagatctaaaacagctgaacatctgcaagagcagcacattggtatgctccaaaattaacatcatgttaattgaattaatatgcaagaagtgggaagtttattggagactttggtaaggcacataaactccagaaactgcaagatagaccaagaatagggtattgtcacaacagtgtagatctgaggtattccagaacatcccctgaacataagggctatattattgtgtcttgcatttcccaccactaaaaggtaagccaactatccagtaggactttcagattttaaaagaagcatagcacacacacttaaaatattattctgactttatgtccagtgacacaaaatgcatctagtttcaagtagagtttagagaaggatagggctctacaacagttctaggctaagatataagtggttctgtcccatgggaaacataacctagcagataaaattgtatcatagatgtctgttgaagaaaaatatgctatgtggtggttgttaaaggtaagattcaatagaagaatcataagctagacttgtacagggataagtcaaaatatatcacttgcagtatacttttatgtacttcttgagaaatagatcttgtaatattactgaaccctggaatattaagtaaacttgtagccataacttccctttgtaagctaggtttagtcctattcaccatatcataaggtcagatggcactagcagcaattcattataagatgtaagtgatgtaatttgcaacaggcataaataagaccaaaggacagaagttagttgcacaagcaggtggcccagacttctgtgtaactaacctattaccctggcacttctccatcaactcaatatatgaatgcaaaataaaaacttattctggctatatcttagcctcagtcaggggtggccttgaaaaatagtgcagaggttaattttccaatgatcactcagtactacccttgagtctgaaaagaaataatggccatatgttagaatatatatatgtactcataaacagtagtaatcagtttgactggttgattaggagcctaaaaatataaagattggatgattgggaacaagacaatcagaacaaatgacatacgcatgaacttataggagtagacacaaagtgtcaaaatctttgtgtgtcatctcaatgccaaccagaaaggattcacaacagaagagctactaaatacctaagtagacagaataactcagctataataacagaaacagaagctaatcatgagcttaacagcataaactcccgctcactaaagctgacatagttactgactccagcctgctggcaacagagaccaatgcctatctcttaatatggcaccttccctgaaatagaccaaccagccacttgatggtaagttgactttttttagccacccactctggaaagggcagaaattcatactgactagagtctacatcaattctgggcacaagtttgccttttctatctccagggccttgactgttgcagtattcaagggcttaaaagtttgaatatatccagcttgagattctacataaacatcacattaactataaaatctactcttcaagaaagaaggtatggcagtgggcacatgatatgcaatctactggtttcataatataccatatggtctaaaagctggtggcttactatagtaaagaatggctttgtcaccaataggtagaagggtgaaagcaggagtggacctcttatcattaatcccagtaactctcttatttttctttctcatcactataactctaacccccataggcttagaggtactgtttcctagatccaaaatgcttctgagggcagagcaagagtttcattaagccgttaggtaagatactgtccagtcattctagactcctgatgccagaacaccagcagacttgaaaaaaagtcagaaatctcagtggaaataattagtcctgatcattgagaataagtagaattcttcatacaatgaaagcagggaagaaggactttcataactagcagatcttttgagatgtcccctgatacttatttgtcctatcttgattataaatggacaagtccaatagccacagcttgagaaaggcgtggcatatagggactcagatttcttaggggttagtgttatttcacccagtcaggtaagccaggtgtcatccagtggtgttatctcaggtgctaacagtgttatccaggggtaaggggaagaaaaaaaaatgtgtaaagaaggagagggataataaataccagtttaaacctccccaaatctgctacagaagcaagatgtaacactgtgatataaagagatatatatattggtttttggtcccaggttcctggccagaattcctaaaaccatggtaaattcccatgtcataagagcaatcggagcatcttttgttaaatatttggttcttgttcccagttcctgaaatagttctggagctataaaggagaaaggggcatcttttgttattcataacagtcccctttcaatcatacctgagtttatgttaacaaagtaactttcaaaactccccaaggatggagaagctgattgtcagggaaactaaacatgtcattagagggtccaaacttcagccccactccagacacatttccaagaaagggagagggaatagtggttgagtttaattaccaatggccaatgacttaacaatcatgtctttgtgctgaaaccttcataaaatccttaagcaaaagagtttggaaagctcctggatgaatacctggagatgttgagatggggatgcacttctccctcacaccttgccctgtgtgtctctttcatctggctgttcctgagttttaactttgtcaaaagacagaattacaataaatttagtttgtcatctgaaagaccaccaggatggctaaacagtagaaaagagagttaggctggtaatactggtttgcactctggtaagagaaagtctccagtatggactcaagtttctctctcttcaaagaggggaaggacaggttggattttatgcctcaaaggatctatatcacacacatttagcaggttttgggcaaaagctatacacatttaggaggggaatcaagtgcatgcagattgggtaaacaagtacaatatagaacatgcatctcaggtctactttggagttggattttatcattaaaatgaggtgaaatttggctctttacatcaaaatgtcacagcccagtgggttcatcttgcccagtgcccagaaaaaccaatgcactgggaaaagcaggcattgcagcaaagaaagagattaataatcacaggagcagtcagaggaaagaaaaggagctatttctcaaatctgcctccctaaaaattttgaggctagggttttctaagggaacttctgtcaataaggatctagggaactgaaacaattgattggctggggatgaaatcacatgggtgtcttcactgtcttcctgcaactgagtcaattcctgggagacgatctcagaatcaggtgatgtctcttggtctgctgaaatgccatatgtgaaatatatctcaaagaccacttctttaagtttggcaatagtgatgttatctacagcagtagttaaggaagttataacttgtgcccccttggttatgtgactctggagcagtaagcaacttatagaaaagcaagctcagccatggcaggtatttgcttagcaaagttcaagcccttaccaagattctaaccctgtgaccttttgttagtctttacaaatacagttttaattttctttatataaaggaggggattggcttaaggaggaactattatggcctccacacaagaaggagcaaaagcaattcaccctggtagaagcaagatggagtcagttatgtcagatttcccttaccactacaatatttgcaaaggtggtttccaaaaagtaaactataggacaaaaagattatctatgcacagcctctataagctggttgaaactggcctaagttctgcagtagcttatcagaaaagaatttgtaaggccacccctctctctaatcagagagcgcctactgttagggtgtttagccccagaaatttagaaatttgctttgtcagccaggcctggactctcaacagataactttgtttccttaacgtttgtgtccatctaagtttaaacaggggcatccagtttgttgtctcagatcacaagtttaaagatctcaattgcctctattgtgactctagaatcgggcagcactttatttcatgaaattgactaagtattccaacaagctgagcagagaggattggttttgtagacagaaagcactgaagagagacgaaacaaaaaaacaaaaagcagactgatcatttcaaagttaccttcctcgtaagacaggagcggggagagagaaccctagaaaaataactaattagttagcatcaggtggctgtaggctacctttttcatgtaaagattaaagtagaagggacttcattattacaccaactgaagattgaatctggcctgtttaggaaattggttgttatgtttcctgatttctcaaaaggttagataacaacttagctttagtttggtgatgtgggacttcagcataggtgactccattttggtttttagtctggcctgtggaggccgagtacaggagcttagtccaaaacaatggcttcctataacttttatgaaacattcttttatcattaaccagtaatctagtaagttactgtttttcttatttctggcagccaagctagcaaattatcaaaccctggggggagttttggaaacctcagatgtatagccagtggatcagaagttggaaaggagacctagacttgtgattggcatctgaaatgagggtggttttgtgagactgagctggtaacttgtatctcatgctaacaccaggtaggtagtatcagaattaaattaaattgtaggccaatcagatgggatctgcagagaattagataattgcttgatataaaaaaagtccacacggccaggcgcggtggctcacgcctgtaatcccagcactttgggaggccaaggcaggcggattacgaggtcaggagatcaagaccattctggctaacatggtgaaaccccatctctactaaaaaatacaaagaattaggtgagcgtggtggcgggcgcctgtagtcccagctactcgggaggctgaggcaggagaatggcgtgaacccaggaggtggagcttgtagtgagctgagatcgttccactgcactccagcctggacaacagagcgagactctgtctcaaaaaaaacaaaaacaaaaacaaacaaaaaaagtccacacatttttgtgtcataagtgtcgtgtgagtgtagagtagaaaacagcttgtttttttttttttttttccttttacaggggttgcaatggattctattattcttcctctttcaacttgaccccactccaaaataagtttattatcttaaaggaataaatcctgacttccagaacaaaagcatttattcccccagctgacagctctccaatgagtttctctcttaggactagcccttggccaaaaataacttcctcatccaaatcttaccctaggtactaatttcaatagagtacttcctaatcacattcctgtatgtaaagttcctctcaaagtttgcttccttgagaaacccaacctgtaaacatgaacaaggcacactttgccaactcagtgacataattttctatataaacacatgtttgaaagtgtcaaaatatttccacgcaatcccctcaagtacatatacaaacacaagcatgtatgcatgtacacatacacacaacatattcaaattgactgttcttgttataaataatttttcctttcaaatttcctttttttctatagggaattcaataagcactgattcaaaagtacttgaatatcttaatgaataataacttaatgaaagctaagcttatttttcattgttattagagatggtgtactatctgtattgttatttttttagggagatctagttgcatgaataacattccatggaggaggatcaaactcaccagataactaaaatagaccagaaaacaagttcaaagaagtcgagtgaacatgattacataataaataggagaatttatatttagaaataagtaaaaacattaggctcagatttgcccaaagataagcttgtttgttttggcacaaggtattctattttagaaagtctaaatagaaagtctaagaatagttttgtatctcatttggaagcaaaatgtatctgacctgatctcatttagtttcaaatcttgacctgaagaaataaaggtttattgtggtatgtatgtattttacttggttggaatatttaaacattttcttgtagaaatattaaggatttttattacaagctgcagtacctaacacactggacttgttacaaagtgtacagtatatactgtgtattcatcatgtcctctttctagactttgaaaatttctgaatgccaaaacatatcttatatatgtaatttcaatactaactttattcaaaatgcaataaaatataaaatgtaatatatatgcatgtttaaaatggcagcaaaacctgagatctcttagggacattgtttaacgtaaagaacttattaatctcttctctaaaacaagtatattattctggaagttctttgaagcaatgctagaataatttagccattatatactttattttaatacatataaattaggtgaatatataatgatttagaagggcagaagaaagaaaagacacccggaatgaaattgctaaggatttatggtgctccaaagcctacagcctataaacaaagctatcataactagctttatatgtataatcaaccatagagggtaaaattattgttttaggatgttactttgttgttttacccaagcattgccttgatctttattattaatgcctgctacttgccttctttcttgttatttttctcttctctctaaatctctcttctcacaaatcaatatttttgaaattccaatttaattattcacctagtaaataattgttctgtccagtagttgtgtttttatataatgaatggctctgttgggagagtgaactattacccacctccccacctccttcaggctaatgctttatttaggtagagtaaagcacggtgtgagataatgaggagtgtctggatggagcgatccttccgaatgcaacaataatttcgtgaaatgcatattcagaaatgccataataaaaacctctgaatttcttagaatgcactaaactgtgcaaattaaactctctgtataacctcaatttatgcctttgaaagtggatataatgttaatattaaacccttcttattgatcccaccatttatcacatagtccactgttcatttagtatcaatccatgattatcatttttacaggtttaagtctatttcagattacttccatttattggagaccaataatgtcattttattaagggcattgttcataagtctaaatgcaacctacctgtaatgtgtactattgcagtgacaagtaaatgactatttgtaaattagcaacctgacaaaaacaaaaaagtagttaaaattatatttcaattaaaatatttaaagaagagccttttatatctggatcatggtacatgaacacctgcaatcttattttctctgtattttaatatttcatattaaatatgttaaggtttctcaacgcaacaaagacactctcaaattaatttgaccgatgctatttcatatagaaattagtcttaggaagcttttaaattccatctgatctcgtattttatagtagttcttctaacactttgttcatttgtggttttatttgttgtcatttgtggtttcatctatgagaccacagcattgaactttgtaaggaatattctaagtggatatttttgtgaaattaactttacggtatttgaatagcgatattagagagttactatatgaaaacaggtaatatattgtttatatacggttgtattctgcctggtcttacagattctgtttctgttttattagctgagtgagatctgaaatgttatgtttttcctctttattgctaatgtttgcacctatattccaaaaatatttttttctagtaggaaagtattattatacagttttatttggtgtcttccagcctttccctgtggccagaaacatgctgaaatctcatacattataaaattctagtcaaaagaaaatcaataatgaaaaaacgagtcatgttctgaaagtcatgctatatatataaatcaattacagatggataagaaatttaaatattggtataaagtaagtattgtagaagaaacaaaaacattatctataagtaaataattttaacaagtacaatgtggacaaattaaactacactaatattaagaactttattcaggaaaaacaccattgagagagaatagagacagaggaaaaggataaaataaaatatttttaaaacataatattaaccaaggatttttctagactatgtaaacacacttggctgttgaacaacacaggtttgaaatgtgtggttctacttacaggcagacttttgacaacagttgcactgagtgtgcctgcctctcctgcctccccttccacctcctctacctcttcaaactctgccactactgagaaaacaagaccacctcctcctccttctcttccccctctttcttagcctactcaaactgaagatgacgaggatgaaaacatttgtgtttcatcaaacaaaggaacgatgattcatttccacttaatatatagtaaatatattttgtcttttgatgattttcttaataacattttcttttctctggcatactttattataagaatacggtatataacatttataacatacaaaataggtgttaatcaactgttaatgttattgataagctattagtagttaaggttttggagagtcaaaagttatacacagattttcaacctcatgggagattggtgcccataaccctgcattatttaagggttaactgttaatttaaaatggtccagtgacataaacatgcccttcaaataaaatattcaaatggctaataaacttcagaaacaatgctcaacctcaatagttatcagaaaaaaacatgcatgctcaataataatataaagtttaaaatattgaccatactcagtgtcagtaaggatgcagaacaactaagaccatctcaaactactgagtaaacagataaagctactttggaaaaatattatggtgcaataatattaatcatgggaatgaaccatatatatatatatatatatatatatatatatatatatatatgcatcaaaagagttataagaatgtttctagcagcattataagcaacagccaaaaataagaaataaaccaaatattcttcaacagaagagtggatatatatattttgaaaatataataataaaacatcattgcatggaagacaactagtacatacaagccacacacatgaaacactcaacaaatactcagtaaaagaagccagaagctgatgagtaaataatgtgccattctatttatataaagttttaaaaatagcaactaaactatgatattaggagtcaggacagtggtcacttttgcatggggagagagaagataatcttcagggtgatgacttgccagatcattaaagttatatgctttaacctccccttcttgcagagactaatgctgggtaatttgccttctcatcccctaagttaagtagaatgaaaagtctctgagtaactggtaaatattataagtgcccagacacccaatgagagggaactctggcctctttttcttcaaaacatatatctgctcatatgcactttgctttgtaataaaattatttacaacagctaaatataataaaaacatgctaccagaaatatttccatgatataccgtggaggaaaaataaataaattcttaatttttttgttcttttagaaagtctttttttatacattcgagaagcctttgactttttgctttgtgcatttatgaattttattttaccatgagcatatatcacttctatgattttaagaagttgtgaataagcataatgatgccttggaaactttaaagactatatcagagaaacaagtaagtagggaagtatgacctatatggcagagaaaaatcaaccaatagaagcaggtgcaaaactgaagcatatggtaagatttattgacaagggcattaacaggattattataagtatattccatgtgtttaaaaaatagatcttcccataaacatatttaaaaatgtatagaagacataaaagagacacaaattgagcttctagatataaaaaagtctaaaataaaatgtgattaaaagaagtttaaatgttgtagaagaaatgatcaccaatgaacttgtatacagactactataaactatccaacctgaaagatagtgagaataaagatggaaaacaaataacagaccaacagtgatctctgggaaaatatcaagaagatgaatgcaagtgtaagtataaccaccaaagaagggggacagaaaaatcatttagaaaataagatatatattatttttcatatttgctgaaaactaaccccacagatacaagaatttcaaaaatacctaagcataagagatataatgataacacagcaatgtgcataataattggattgtatcatataataataaagagtaaaatcttaaaaggattcagaaagaaaatgacacattatacacagagtataatataacaatagcagctgacttaaatttttttagtgagaagagagtggagtattatttcaaaatactgggaaaaataaaaaaaccctgtaacctagaattctgtatccagtgaaaatgtctttaaaaatgaatgcaaaataaagattatttaagttataaaaatataaaataattcatcagcagcagacctatcctacaagaaatgtttaaagaatttcttttagcagtagtatgacaaggtggctcatacctgtaaccccagctacccaggaggctgagatcagaagcttgcttgagcccagtagtttgagatcaacctgagcaacatagcaagaccccatatctaattttttttaaagtagtcaggaagtggcacatacctgtagagcagctacttgggagtctgaggtgggaggatccttgagcccaggagtttgaggttatagtgagccatgatcgtgccactgaatgtcagattgagtgacaaagcaagactctgatcccttaaaaaaataaaataaaatttaaaaagttcttcagcagaagaaaatgacactagatggaaatctagattcacagaacggaatgcaaagcaccaggaatgccaaatatacctataaacataaaatacttttcctagtttaaaaatatctttaaattataataagttatttaaaaacaaaataataatgtattatgcgatttgtaacataaatttaaagaagtgaaatatgtgataaccatagcagaagaccaggtgaaggaaaatggaattacagtattagagggtttttatattatacactgagtgatataatattgttttaagtaaggcttcaataagtttttaagctatcacctaatgcaacaatgaaaaagggcaaacaaaatatctttataaatattcccataaaagcaatgaaagggaatgacttaaaaatattcaaaaagaaggcagaaaagagaggaaaaggggaaaaattgcagatgaaacaaatagagaaagaaaatacagagatggtagtttcaatctatgtcaatactcattttatatatatgctctaagtacttaaataaaaataatcaatggtcatatcgaattaaaaagacccaattatatgctttctccaagcagcccactctaaatataaagacaaaaatatattataaataaaataatgaatatagacatagtaatgaagagaaatctggtcaaagtagatttcaagcaagtattgttacctaggataaaaagggacattttcataatgttgtgtcaattattaaaaggaccaaaaatcctaaatgcttattcacctagtaacagaacttcaaaatacatgagaggcaaagtctaggaaaactcaagacaaaattacaactgttttctgagaagcaaatagcaaaacaatattaaacatgtaagaatcatatttggaaaaacttctataaaagaaatgtgtgtgaggccaggttagactgaaagaagcatcagaccttgacttgtgtttgaccctgagtgtggagaatgggataaagtttgtgtgaaaggatcttggaatatcttgtagcctagggaagattcagacaggccatcagataagtccaatattttccaaaaatcgtaacgcttactatttctgccatactgcattggctagcccatggggatgtacaataatacatcgtgtagttcagcacttggggcccttggttaattaagctccctaaaatcagagatctataaggtacattcacactggttacacactggtcaacccagttcacccactttgccacacagatctacttatccaaaaaggatttgtggcagcaacattgtggtcctgtgcatttttcatcaggtaaaatttgaaagaagaaacttagtggaataaactacactttcatcaatacaattgatattgaggcttctctctctcctttctccactagctaatctaaagttccactctaaatttcccttatcatcagctactactttggcatgttttggtggcctatctcaatttcattgaggaagctgtaatcttttattatcatacactcctcagtgtgtagtacctgcccatgctcatttacacttacaatgaagcatgggattggtaagcaggatctcctgggtttcacaaatgctcttccctcttcccactctttaaaaatgcccttcctcctccttgccagtatggtgattcctcttctccccggtggtacacagaattcaaagtgctctggcagacatagtgggcccattattgggccacctagcaagaatgaatcactgttgaggaggacctccagttctgcagaacccataaagaagatggggaaaaaatattccctggtgagtcactggggcttcttccaatggagtagatggtaagggagtcactactttttccaaccctttgttcccagtttcatgcatttgtccttcctatgggagactcagtaccacatagtaatctcctccttatgaaatatagtgtgccccaaagaacagcacttcatcatgtcagagttttctctgagctgatgctttatgtgcacctttagaaagccattctggtgttctatatggttgacttctttgggatggtatagtactaatatgacctgtgggtactatgggtcatacacctacccctcatgtcttcttcagtgttaaacaggtcccctagtcagatgtcatatttctcaggattgtctgtgcatcaggtcttcttaaagccctaggatagtaggactcttacagatagtctgtgtgtagaaaaagcaaatcccacctgaaatcttccccctttaaggacaagccaagtgacctattatagaaagggaatgaggtatctacttaccaccaagtaagtagttgagatctttgagaaataatgctacgttaagagctcaatgtaggtctgttgctgggaagttggttattcagaaatagtagtagctacatcagccttggtaagtctgtgatgtcagacccataaatagcctccctttctgacagcatgaccattccgttcatatgcctgttgtaccaattctgcagtgactgatgatgaagatcagcttaggtgtattcactgagtcattttgtctacttggttgttaagtgacttgttcacagtggatgttttcttgtatgagttaacatgtgacataaaaaactttatcctctgccataggtatattaacaggatctaacctagatacccttatctttaactttctagttctttcctgtccacaggtctgtatataagctcaacatgggccatttcttctgacatatacaaggatgaacaggtgcaaaacttacagttcgactcattagaaatatttttcttttccactctctttcaagtctgctcccaaatgtagctgtaatgcagttgttgtccctcttcacgatgcacccatgttctgagctaacttgcctataaaccctacttagactgttcctcatctttcaggtggttatataggccttcctatacaacatatgcccaggcagtagtatgcatgcaatggtgataagtgacataggggtctgagaaacctgctaatgcagctcactcatactttctggtcttgcttaggtttgaggctacatgtaacattgctatcttactatggactgctactgggttcatatgactttaggagttgataggcctgaaagaatctagctcacagtgagaagttccagacatagttacttggaatcctatggacaaatatcgggcctcagtaacatgccaaaagctgtttcttaaaaggtgtgtaattgttgcagatggcataaacctgctccagaattttaaagacatgcactcatattctttcacgagcttgtcaataaccccatcattccctcttttatccttactgtcacctctactgtgacatggtctgctggattgtatggtccagacagcagaaatggaaacacaatgacctgggatttctgcaaaaaaaatcccttcctactagaaggcacactcaaaattgtcagctttccatgtaattccagtatataagtcgaagtggtgaccttatgtgggaaatatgatacctctaatccagtgggtaagaggttccgtgtttctttccttgtggtagggaatgtaagttgcaataatttttatttctcactgcatgaggtattctagcgttgtcttgactcctaaaaacatcactaaagtgtctagtccctgagtcttcgtagagtttatctcttatcttctgaggtgcatgtatttcaccaagacttttaacatactaaccatctcttgtttgtcttatgtaaaaagctcatgctattgatgtaatgaatcagtgttatgttctgtgaaatgttcaggttgtccagttctgcttgattatattatgacagagggtagaacacttaacatagttttgaggcaaaactataaataaatactgttgtcccttccatgttaaatacaaatgacttctggtcctcttatatttgaaatggaaaagagcacattcatcaactcaaagtctgtatgctataaatattcattaagaaatgacacaatgtcttgcatagcctgtgtagtccgaactcctgccctgttaggtcttctataggctatagtcattcttcagactccatttggcttacagtagctaaactgacatattaaatggagataaattatagacaaccacacctgtatcctttatttctttaatattggcacttatctcctccactcccttccccaacaagaatacgatactgcttttgatttactatcttggttgtggggtggaaagaggaggcagttttataggcttctttttaatcttccccatcatgatagcctttccacaacagatcagagatccaatgtggcagttactccagttaccaaacatatttccaaacatgtagatggaaactgggaacaggatcactgggtggatactcagacccattgtgagactgacttttgccaggactctattattacctagtcccagtgagccccaatgcaacacagggctgagataataatatgagtcctggggtatcaatatccttttgtaatgtgtctaagagtccttgaaatgtctgtgtattctctttgtctcagtgtaccatcagccaagtaaatggttataagtccttttggaaaagaaattgagacttgtcacaatatattcttgcattggtgttacagagccctgtgttccagagactcattcctacttttgataagtgggttcgggttctaaatatcatctcaggtctgtgatctgaacagagtcgtggctttttagttaggcaattaccttcagattcctgattctctaatcgttttgtcattgttgttatagatgttaagtagcacatttgttgcctgttcaactattttgcctctagggacaatgatattggtcaaattcatttggccccatttctaaccttggcagtcatcatggaaattccagtctcttggatgccagcagtaagggccaccacaggcctttattattaatgggcatgaagggatccacttcaacctaatagatataaatgaacctggctctgttacagcctcgttttctatcatccatggtcttcagggttgacatcaaataatttagtgatactgtcaccgcccaccctcacttctgatggtctttgtgaattaagtatcctctgagactttccatggaaactaatcttctggtggcactttaggacttacataatacatccaatccagcatgcccatctctctcagcctcctcacttctttctccaccatctgccatggcaactgaggcattcccacttgggagagatttagatattttaaaatcacatttctaataattacacttagcagcaagtttgtcatattctccggaattcttactagatgttaaattatatatcccaaggaaacactctcaagtcaatacattctctcttatctagtcttacattccagttcccctttatcaggcaccctcaaaaatcaataaatcccaagattaatctctcagtgacttagtatcagccagctaattatggcaattatttaatttcagagtctctttcctcctttatgaagcccaacacatggctagtttggttatggtgggatttcatcctaggtatcaagctgacaatctggacgtaggtggggtcaacctctgaagggtttcgtattgccttgccagaaaaagatttatgcagcatcttccagcccagtggaagatccagtatttagctgtgaaaaaccatccatagccacaataagtgtctccttcccttttctgatcattttgcgttagctagttataccacattgacttttgcatataaattatttcacctaatattgcatgaaaatctagtgtttcattaagtctcggttggaataattggaccaattattatgttttgtaaaataagctgcccgttacaattatttataaaaatacaatacatgctcctgttgcaactttcaaaaacatagacaatctcatttatattcagtagtaatatctgaatgaacatagccagttgaatttagtctcaatgctccaaaaactttcttgtgtctctttaaaaataaggtctgattactgttttgtgagtttgcttctaatcatatttacttcctttacctgatcaaaattaatcttcatttaaccaaggacaattattaaccatatgatttagaacttcatcttgcagatcatcacaccaatcaactcttactatgaggacaagtacctctgatttataataactataaattaatcagtatttacaatgaataattcattcctggtagagcccttggattgggattctttcatttctctcagttcaatgctctgagaaccactggaaagggacttcacatgacctagcacacctttgtctccgtgaaggagtcaaggtggtctctcatcagcaaaatagcctcagattgacttgttctcattttgatctcctgaatatttatggaaactaaagcctttgcagtatctcctgtgtatgatctactggcctcctttgatttaatacatgtttaattcattttcatatatcaaatatagagaatttatattaaatatcaacatcagttaaggaggtataacaggataaaaaggagagaaaactcttcttccaatattacaatgtaataattaatatttatgttttcttcctgagagacttctccactgaccattactgatacagctgacaggggtaactgagaacataaatcttgactgctatgttcaaaccatgactgctatggtttgaatttttgtctcctctaaaactcatattgaaatttaatcttcaacatggcagtattgagaggccagagcatttaagaagtgactggggacgggtgcagtggctcacacctgtaatcccagcactttgggaggccaaagcgggtggatcacaaggtcaggagttcaagaccagcctggccaagatggtgaaaccccatctctactaaaaatacaaaaattagccaggagcggtggcaggtgccagtaatcccagctaatcaggaggctgaggcaggagaatcacttgaaccctggggtcgggggcacaggttgcagtgagctgagatcgtgccactgcactccagcctgggggacagagtgagactccatctcaaaaaataaaaataaaataaaatagaagtgattaggttatgtgagctcttgtcctcatgaatgtattatttcgttcctgtattaatggattaatgggttatcagaagagtgagaatgatggatttccaagaagaggaagacagacctgagctagcatgctcaactctatcacatgatgccctgcaccagctcagaactctgcagagagtgtctgtcagcaaggaggttctcaccagatgtggtcactcaaccttggacttctcagcctccattactgtaagaaataaattcctttcctttataaatttttcagtttaaggtatgttataaacaacagaaaacaaactaggacagtgaccacaatacaaattataaagtgtgctcagagtgcacaaaatttataaatgcaccaggaataagtgtctatacattggaaatagaaataaaatcacgtgtgggtgtttcaagctagagcagaaaaagagccaggagctatatagctatatagtaataataagtattcagaataacaagggacctagatatgaaattctgtatatctgatgatcaggagatgatcagaacagccagtgagcaggccaggagagcagatatatgaggcaggtttgaaggggaatttaaacacaaaaggacacccttccccaaaatattgtacttaccactaagtgaacacttacttaaatttcagttaagcaatttggtgtgttactccattttcccaccgctataagaattgaccaagaatgggtaatttacaaaggaaagaggtttaattgacttacagttccatatggctggtgaggcctcaggaaacttacaatcatggctgaaggtgaggcggaggcagacgctatcttcacaagaaaatgcatgaagagagaatgaatgaaggaagaacttgccaaacacttaaaaaaccatcagatgttgtgagaactcactcactatcacaggaacagcatgggagaaactacccccatgatcgaatcacttcccaccgggaccctcccatgacacgtgcggtttatggggattaaaattcaagataagatttgggtgaggacacagccaaaacatttcttttgttaactccattaaactagaaagtggaaacgccttccccagcttttagtttgtgctgtttttagtatgctacactacacacactctgaacatattttaaaatatttaatggaatgtatttcctggatattgcaaatagaagataagtgataaaatatgagtttaagggaaaagtaatagcgatttttgacagagttttttattaacacgtctaataattatatttcgtgagaagatatcctcaagaataataatgctagtgaataaattgaagattttactttctcagtcaacaacagatttgataatataggtgttatatttctaaatatctgcaataatatctaattacatttttattgtgaatgagggattgactattctgtacattctagagttaaaaatgtttgtcttggttagaaaaagcagcaaattccaatacataactgaaaacctaggcctagttttgtatatggaaagagttaaatcaaaggctcaaatgacaatcagaacactcccaacttataataaactgtagttgattaatagcagtgaatgactatgaagtatgaggaagtcagctttagagaggagaggtacggaagttaactgaaagacggagctggaaatcatgtaaaatccttgcattaaggcctaacagcaataaaaaatatcaggtgtacacaactacaaaatggtagttgaagttaaaaaacctcagtcaatatatcaagtacaacttaaattttaattgcacaaattatcttttaaaaatagtatctcaaactaaaaacaaggtgaatcaaaatgtgtccataccataaaataaaaatattataaatttctggattttaattttttttaaaaaaattaaataataggtgaatatttaaaaacaatcagcaagtcttccaacaatcaactgaaaactaactagaaccattcaatgtctcactttctagtacaggcctttgacaacatttgcagaatatcaccacaattaacgctctatatatatgcagatagaaggattgttacaatgacagaaaggtggagaggtagaaagttagacagaaaccattgctcttaaatggaatatttctcaatattcccattgcaactgaaatatgaaaaataaggtggggcatgttgggtcacccctgtaatcccagaactttggtaggctaaggcagttagattgactgagcaaagtagttcgaggccagcttgggaaacataacgacactctgtctctgcaaaaaaattaaaaaactaactgggcacggtggtgcacacctgtggtcccagctactcaggtggctgaggtgggaggatggcttgaacctcagaggtgaaggctgtggtgagctgtgattgaaccactgcactccatcctgggcaacagagcaagaccctgtctcaaataaataaatatacacatatagtgataccttaccttgttttaatatgaatagactctcccttagctgagaaagcccttttggctccttcatttgcaagacgtcaagggctccttacccacccccttcctcaaggacttaacttgtgcaagctgactcccagcatatcaaagagtgcaattaactgataaggtactgtggcaagctgtgtctgcagttcccaggaattcacctgggtgatagtaccttaaagcccccacgtttgtgtccggcagatagcagcacccagagcccccgcacctatcaccttgtgatgaatttaaagcccctgcacctggaactgtttgttttcctgtaatcatttgtctttttaacttttttttgcctgttttacttctgtaagattgctacagctaggctccccctcacctctctaaaccaaagtataaaagaaaatctagccccttcttcggagccgagagaattttgagtgctagccgtctcttggttgctggctaataaaggactcctgaattagtctcaaagtgtggcgtttctctataactcgcttggttacaactatatatatgtaaatactatactacatatatgtatgtatagaatgtcagaaacaacaaaaatagaagtaaagctgaagcaattattaaattgtagacacacgtttcttcaaaaacaaaaatattacttttgaaaagatacctctaacataacattttgagtataataagttgttatcataagtgattttttttctgtgacaaattttagtttcaggcattggtattaactcctactctgcaatatgaggttgtatgcactgctgctcagcttacccaaactataaatactgattttttattagaaaacagatttcatttgcctactttctgcaactacaatgtttagaattttctcacctttaatccatattttaaaagtcagcgttcgaaaccagtgttttccccatagtttttctattcttgagtttttgcttttgttcatctcttgattggctaagtttctttttattttttgcatgctgataattttcatattattttaagtttcacggtacgtgtgtgggatgtggaggtatattacatagataaaggtgtgtcatggtggtttgctgcacctatcaacccgtcacctaaatactaaacccagcatccattaattatttttcttgatgttctcccccagcccgcacctcccaccacaggccccagtgtgtgttgcttccctccttgtgtccacgcattctcattgttcacctcccacttatgaatgagaacatgcggtgtctggttttctgttcccgcattaatgtgctgaggataacagctaaatgaggataacagttgattatcaaaaaaaggttggtttgttttttaatcaaggcaagcttaaatatgcattatttcttggagtattaaaagtctatctgttatcaatccttccacttgaaagaaatttttgggtcatattctcttttatctagaactttgtgtatacttttaaataatgttctttcataaaatcttattaagggaaaatctaggccagcctaagttttttctcagttttattttacttcagtagttatttttctgcttggatttccatattttttattccttattatatttcagcaaattcatctctgtatatttagatgccaatcattttgcatctttttgtcctcatagagtggatattcttttgatccacagttttaaatatttgtttcaggaaatttgaggtaagctttcttctgtagtattattgaatacattttgtggtgttctattcctctaaacataatttttgtgaatgtcagatctttcaaatctgtctttcatatttatcatattttgtcatatacgtttctgttttgtttatgtatacattaaggtatttctccatctacctgaatgtttctttgttcaatattttaaaaattatttttaacattttgctccaaaaatttccagtgatatacaaggtagagaggccagtatcatgacccagcctatccttgaaatttactaattatcaatttgtgacatattttccatttatacagtcatgaaccccacttggagtatttagaattaaatatataagtccaggccagcttcatgagggtatgacctgtgcagtcacaagtctaggtctttatgctttgaaagatctcacacttggttgaatgctctgatatcactgtcttgaaatttgtaatagttttcaaaggacaaactctggagccagtcttgatccccattcactttgatctcagattccttgacccttttagagcatacaagtaaccccaaagttaaagttagtcctataagatatactgataattgtattaacaaggaattagaaaatgactattaaggttttcacgtttcatatatttacacacactatctttaattttcacttgcaccctataagaaaatataagattaaatatatttgaaaatttaggggggaagataatacagtttaaattacattaaattagggtcagagactctaggttacattgactttgtcatttacccatgaatctcagcaatcatttccccctgtttgatattctctattgaaaagagggcagcataattcctgtgatataaaattattagaacacattgtataaagtatcttgaaaagatgtgtggtcgatgtatgacttttcttatctcattttcttgtgtttaataataggaaatgttatttggcttgagtattctggagaatgaaaagagtagaactctttagtagggttgatcttaaaatagatttttggatgctacaaactatgtgctgtgttagtgatagcaaatctttggaattggagaaaaatggaatgtgtgagagaaatggtcctagttatttacctgatctttccatctcctcctattctctaaccaaacactgaaacgacaagccagaataagaaacaattttaggaagtacaatagaaagattgaagtaaatgattataagtaagattttttggttacaggaaaaaaaattaatttagttaagcagaaaaaggaatcattattggaaagacatttgggggcttataaaattcctttggaggctaacaagttagtctgagaaaacaggcagaaatgaagaaaggcttgccaatgggtaagccaagaccacgtttaagaagaatttgctgaggatgccatttctagcacatgttgtcaatgctaatgttaggttctgtcaggaagcattcaaaaccacaaccatgaactttgtacagtcattaccaaaaataattatcttttaataaaatggatttaaaaagttcatatctgttaatctacttgtgtgtaaggctgtatatatttatgaagaaatacatgatagagcgtgtatcaaaatataaatagattttatctcaaagtgttagaatttaatctttcttcattatgtttatctgtacattatttataagaaggtaatatttatataattagagtattaatcaaattcactctcttgtaaagaaaaaaatttctggctttaaaattagccatttattacaaggactgaatatatcataaacatatgattatattttgacatggatagttataacattctattacataactctctagatagtggcagtcaacaaatagagtataatcttactgtatggatatgctagaattacttataaatcaggaacaaagatagaaatggcctttcccactgttccctgtgtaagaaaattaaattaatctgctgggagtgataaagaaaattgaggactccaaaggtaggtaaaattcttttctttgtaattttttagagataggatcttgctctgttgcccagcctggaatgtagtggcacagcgagctcatggcagccttgaactcctgggctcaagtgatcttttagcctcaaactcccatgcagctgggactacaaacccatgacaccacacttggctaatttctaaaatattttgtagagacagagtcttgttatgttgtccaggctggtctggaactcttgggctcaagcaatcttcccaccttctaaagctctgggattttaagtatgaaccactgcaccttgccaggtgaaacttttaagaggatattttaatttagttttgttgagctgaccccaaaacatctcttctgattattatcacctgcaaatggaagcaacaaatggaggcaacaaaagggaagatttaatcattaccaggtgtcagctattcttgaaggaattcactgttaaaaagtatggactgagcattgcattactccaattgaagaaaagttttgagagcagattatggccacatgggtccagtggggagtgaaagagctttagaaataatcttagctaaaggatttatttgacccgtatgaatgtaaaggccaatcccaaagtataactagtgcccactgccttgagcagcttagggcagattcctgcaagatttatacccataagcttattcaaagtcataaactttatgggatactctgcattacctccctgacattaaatactgatggccaaggtctagaagaaatatgggtcatatctaataacctcactagtaaagaatgagtatttctgatgtggggtcatgagtcatgtgccatttctcaggcactttgaaaatgataattttattattaattcagaattcacagaaacttctgccacagtatgaatttcaggcctctaaagtaaagaaattcgacactatcccagccatctccaaacgaaaacactgcaaaggacctgggagtttaattaaatgctgctgaatatgctgtagaaactacactgaaaacaagatgcagaattaccattgtgtgcctctgatggcactaggaatgcagttattgattttccttcttgtttcatgatgtttggtcgggagtctaggctacatattgatcaccactttgagctgggtgaaggaagtcaggcattgggaaatgtttactcaatatgcagctaaccagaggggcaagctgcaagaaaattttggttagttactctggttagataatgtaaaaggaaaaacaaacaacaaacaacaaaacaaaaacaaaaaacaatggaatgatgtctaactgatattcaaaggagagaagaaagtgtattatttgcgatggtctctacattatactttggtaatcaatcaactcaacatctcagcagctcaaagcaacacttattcccaactcatgatacatgtccattgtgccacctgctgattttgctctgctctatcttctcctgtcattcaggccgaggaaatggccacagtggagtatactgtccaccttcactttagtgggaaagagagcaccagacctagaagcattttacacaactttagtccacatctcattggccaaataaagtaacaaagctgtaactaatgtcaaagagtcatgttaagtacaattctgccatatgtctaaaagcagaattggaatatttgaaagagtctttatgactatcatttctattacaattgtaatttcaattacaatgctgtagactttcaagtaaaagaaagatctgaacatctacgctctttcttatattacttgtatacaaaattatagagaagattgagactggctagtttgctgtctgtagaaaaatcgatttcccacatatgaattccaagagtaatattctctttgtagtcatgtattccatccttttcagagaagatgtgcacaagagcagggacagtttctcaatgagaaagtatatgttttatctcttaatctccaggaatgaagaaaggattgaacaatgagttactttcataaaaatgggtgtgattttctgctaagttagggagaatgctcatttaagccacgtggtacatagaagctactgctctgaagaaatatatattaggttaaaaaaagtcttgtttatcttaagcatggtggcgagaaaacaggagctatgacagaaagcttagtgagaatattactgctctaaaagttataaagtataacaaaaataatacttcaatattgtttaaggaggaagcatagtaaatcataacatttaagattttccaaaaaagaatcaacattgatatatcagaaattcaaagagaaaataacttctttttcaaccaaaatatattaatagttgacataacaaaaatgtacagatatcgaattatccattcaatgagttttggtcattgtttacacctatgtaaccattatcccaaacaagatatagaatatttccttcctcctggagtgtttcctcatacctttttctagtaaatctcctcctccgtaccaaaaggaataacttactgacttctattaccactgattagtatgttttcatattttttcacctcatctgcatgtattatttgtctttggcttcttgagtcaataacatttattcatgttgttgaatgtatcagtagtgtgttacttttatccctgagtagattttcattttaccattatgtcacaggtgtatatagattcacttgtagatggacatttgggttgtctccattttggggacactatgaattagctgcaatggtcattctcatacaaaacattttgtggacttatcttttaacttatcatggaaatatacttagaatgaaattgctagatcattgcacagctgcatatttaactctataagatacttttatatttcttaccttcaaaaacaggctcacaaattccttatcaatgaatatattttgttttcgtaaagagcttgttaaaagaaaaaagagcagtcccagctactcgggaggctgaggcaggagaatcatttaaacctgagaggcagaggttgcagtgagccgagatcacgccactgcactccagcctgggcaacaaaatgagacttcatctcaaaaaaaaaaaaaaaaaaaaaaagctaaaggtttatactatctgaagataaaccagagtacagaaaaccaaacagtgcgtgttctcactcataagtgggagctgaacaatgagaacacatggacacagggaggggaacaagacacaccatgacctgttgtgggggtggtgggcaagcggagggagagcattaggacaaatacctaatgcacgcagggcttaaaacctagatgacaggttggtagatgcagcaaaccaccatggcacatgtatacatatgtaataaacctgcacattctgcacatgtatcccagaacttaaagtaaaatttaaaaagaaaagagtaatgaatattaaaaggaactcatccccccaaaaggcaggttattgagttactaccttaataatgaactggaaggacactagaggaacagtccatgtagcccatttctcgggacaatagatgagagtcatctggtctgaaaagggggaagccacttaatgggatttgtctttagtggaagttattagggctggagagagaagagtttgtgcttttcaggggtggatctcatgggaagaaacacagtgagggccaaaaattagctacacaaaatcaaaccaatgcctgttgactattgcaaacttgctcaatccgtggcctgcaggccacattgtggcccaggatggctttaaatgtggcccaacacaaattcataaactttcttaaaacattatgaggtttttttttggcagttttttaaaagctcatcagttattgttagtgttagtgtatttgatgtgtggtccaagacaattcttcttccagtgtggcccagggaagccaaaagataggacacctttggtctatagattttgtcagcctagtgaattacacctgtcacctaaggtgattactaggttttttccttctctttagtgaaggaatacactgtcagcagcttccagttggcacagttcccctaagtcattcagcagaaatgattgtcacttgtgtactgaaattttcagatcgctatctctgttgtcctatctggagcttctgtctttcaatggcttggagacttttatctttataaccttcaacatagaaaaagagattgtggacattgagagaagcagtggtggtttgaaaaataaagttctcatgacttgtacttaactgggacttcactgtggcactgtgggtagaatgcaaacccattatatggagctttcatatttgcttagtatttctgggtcctggaagtaaatgcactagcctttgaataactctcataatgtagcttttcttaaacattgagtcttcccagttgcaatgcagagatgtattttttgctttgtggaatgtagccacttctgatttccttctttttgattgtatagaaggactcaaaaagtatgtgtcagctgaaatataaacatttttatagccaattacaaggcttttgttcaaaaaaaatctaactaccaactagtttctcaatgtcaatttgataatacagtataggttacttttaaatttaaaatagtaattggtctaatcaacaactgtttttgtttttggaggaagattccatttaaactaaaacgttttggtctatgtaatacaacgttcctgatgttgtaaattaaggcaacatttcttagctacacctgagaaattaggtatattcatgccacgagttggtttttgtcaaaagaataaaattcaatgaggcatcattattcacttagaaggcaaggatatttaacactaacaagatcatttaacaagaagccactctagcagtttaatctggcatatatgaatggagctgaatgaaaacagaaaatatctactatacatagaagactgcagtaatggttggatttttataatcataaataattttaatcttcctgaaatgaattgagtcttatcacatcataaatggctttcacactgaaaatataatggttgtatctcattatattattcaatttcttagcagccaaatttgtttcagtagaccacttcttcctaaaatcacatttctccattggtctctttgacctcacactcttgtctttttcagattactttattgtgtcccaagtcttggcccaagttcctctagaaacagaacctgaagcaaagatcatttgctaatgttttattaggaaatgacttcaaagaaagttagaataaaggaaattattatttaataataaacaaggaaaaagagaaaagcaaataaaagattaatttctaagttgaacacaatttctcaagaaatactacccccggcaaaatagcacaaaacagaagaatttcatctgggttcagtacgttgtgggaaaaaaaaaaaaggagaaagaaaaatttatctatcagttttatccagtatcctgcctcttattgcttaaagtgcaccctaagggaaattatcctcccctgcactttcggaatgtgttagccagcctttatgggcagctgttggagaacatagagcttctatggttacagtcaagtctgaatggacactggtgtttctgtggtcccaagcttatcacgtacagcagaagtcatgctgaacccagcatttgactataagaaaggccaaaacactctgaagtaatattatgataaaagtggccagagtttttacccttaggcccagaagcatggcaagcagttaagaacaggtaggtaggctcaggcagtgaggatgaagtgaatcattgctttagtattctgttgtgttccctttttggctttctaactaccattctgattcatttttttttcagtagtagttgatctagggtttgaaatattcattttttacttaatacactccatgttggtaatgcaggcccatagaacttggcaaagattaagggtggagaaactcatttgcaccctggatgagtaaaaggcagtgactggctgctggaagagagacatgaagcccatcacaccacagactcaggctggtacacagcaggtgtctgtcactgaaggaaaagcaagaaccttgatcacagggaagattagaaaagacctcctccagaaatactggataaattgatagaaattgctctttctcactttttactattttcttgacagtgtactgcactcagataaaattctcatgctgttttgcaggggatagagaggcaggatcaaaagctgtttttcttgagaaactgtgttcagcttagaaactaacatctctgtgagcaaggaaatgaccctgatctgactggaaagttttctaccacaaagagaagtgtagaaatccacgcctcccccgccaattcctttagttttaggcaaaactattacaatgacattggcaaaagtcatcagctgctggaagataggtagcaaactaacttatgacaagatatttttcaaatgaaaaagagaggtcttctatcactgcaggaggggtggaagtcctgtctgtgtgctagactctgtattgagtaggaggaagagattttctgttaagaaggaagggcaaaaacactgaaaaattctcatctctgaaggtcaaacattgagggattacttaatattaagcctggaacaaaataaagaggataacgaaaattcccctgttctccacaagccatgcatggagaaacaagagtagactgccactgaaagaaacatcagaatgtagagagaaagcccttccatgacaaaggtttgcaagatctactgaaagctaaaagtaagcagaaaagttgcactaaaaaccaacattgcatgaacaacactaagaacaaggtagcatcaatcaacagtggaaggaatttgaagatggtaatactgaaagaaaccatgacaacaaatactcaaacccagctcaactcagtttcccagctaaccgacatacaaaaaaagaggcacaacaacgttcagtcaaaaattttacttacctctatctctattgttcttttacagacaatttccagaatttaaacataaattactagacatatgtaaagcaagaaaaaaggttgtcctttgttacattatgaaccagttgacagaaatagacacaaacatggcctatgtgttgagactaacaaacagatattaaaataactatcaatgatatatgaaatatattgtgaaaaatgtggacaacgttcaaatgggtggaaaaattgtgcctgcaaagtcttaccccttgtggctggcaccatcccacacatgtccccactcaaaacaggaatatactgtccacacactgctcaccagtgaaaggcttgtctttctctagaattctgtttattaagactttctttaccctggctctttacttatttatttatttatttatttatttatttattttaatatattttatctaaccaagaaatgaacccctggctctctgatagcacactagaaaacctggatttttatcgtatctggttttagcttgttgagaatatgaaagcaaacatcttttgtatcttttttttccccctggggtagggggcttttctatctttgagtttgggcatgacaccaatgaagaagaccatgctaatgaagatgaagcagggatggcccaaagcacccacatgatggacttctgcatgtgctgctccagctgctctcactctgtcttgagcttctacaggtactgttcagccatagtaagtgagtgtgacggtctgattgtccttcttgatgatgctctgtgtagccagtgtcttgagactctaggccaagcctagaatctcctgcaccagtttttcctggggattctgatgtcacagcaggagaaggtctagttcacccccaagtgcttctcctccgctggcttctgtcctgccactccagccctctttctcactttctgcacaggctttgctgcagagccagtgccggcagttcactccacatctcactggtgtaccccacggtgaccacacatgcactgtcattgcagcaggcactctctctgtgatgtgggctgcatgtggcagggaccagacacttgttggctggtgccttcatggagaaggaggtcggtttctttgcctgcagcatctcctctggaaaatccaccatacagagatattaatgaatcacctcggagactcttttgggccttcaagaccggcactatgtcctccagggaacttatgtacttttgcagatgacatttgtacaatcgctgtcctctctcaatgcacagcagctacaccaggctcagctccagccttgaccccatcatcacctcagggtggtactccataccttgtatcattttttataaacaaaacttgaaatcttgaattaattgaatcaggagcaatacatatgaggaatgtggtatgatctgcttctcaattatcttttggagttacttttacattatctagctaggtaacctcatagagtcagggggcttttaatttcatctatatgtttatgattcctaaatatgcatcttttgtcctgattttgctcttgtattccggtcttgtatatctaattgtttattaagaaccctcacttaatcttctaagatgcatgaaaattaacaaatttaatgcagattataatttttcttaaatagccccttaacctgctattttccccaaactttcttacttcaataaatagcaccactttctatctatccgtgaaactcaaaaaggaaggactcattcctgatgctctttttatgctacttttaatttcattcatcagaatatccttcatatttcaactcagatcatattacaaattcatttttctccatttgccctgcaagtttcacctggagagatgcagtaatgaaatttgctttcttgtctctatttttgcctcattcgtccattctccaaatacctgcaagagtgatttataaaatatatgagtcaaattatgtcgatctcttgcttaaaatccattctttgctacctcctaaaattaggaggaaaatgtccatatccagtatccagatttacagtgcagatttcaagcacacctaagatcctaaccatgtgaactttcttgctgtctccaatccagccacaaaggctggctagtttcctaaaactaccaagggatttctgggttacagtcactcaagagctctttaccaacaaagatgttctctctgtttccttgtttcacttttttttgtctgcttttgtgtttgcttgtttgtttttgtggttagctcatttgtttttgtggttagctcctggcctattggttgaagctgctgaaaaaccttttctagccaccaaagtaaagctgttctttaatcaccacttatcttacatatataaccacatcattaatactttgcttttttgcttgctaaatctattttgcaggttttaaagcatatttaattgtttattgtgtgttaccctgctttgtgggtacattttcacaaatatcaagacctcctatggtatttttacgcttgtggcttttacaagtaagaacagtccctgatgtatagttgttctcaataaatgtttagtcattgagttttaggtatttgagaatcatacaatgtactggaatctttgaaataattgtcacttcataaagttattgtacattgctgtattcacttcctaaatattcctccaaaacacctttggattttaaaaatataacaaattttcaagtctttggaggacactctaggaataagttattttctcaagtggacaataacctcctttaacatacaaattatgcatctctgggagagataaaatgaaaaaatatataagccacgagtatttagaaacttacttattaagcattgtggaacatttattgacatcagtaaaaatactttgtttttagtctttgacctcacatagaagtgactgattcagtgtgtttctatcccaacagctaaaatcaaatatccaagcacagactaacattactggcaaaaaataaattatactaatgacaaattttttataaacactgagaattaacttcatgtatttgcaatgttaaatcacattaattttcctcagtaaaacaggctcttcaattagagtaactctggtcttattttagctagagatataattattgcattttaattattatattaggattccaatttattactagaacctaaatacttatttaagtctgtgtttacttatgtgtgttaaagaattaatgggagaaatcactacataccaaataactttcaataaatccaaaagtatacatgttccaagaaagggattttatgaaatagacatagcactgaaatgggttatgaaagcttaactttattttccctttattgtgatatcattgacaaaaattatatatattcaaggtatacaatataatgttttatataggttacattgtgaaatgattaacacaaacaagcttattaatataatcatcatttcacacaggtaccttaagtaaaatgcttaatatctactcttcacacatttctagtatacaatatgttattttaagtataggtaccatgctggacattaggtctctggaatatttcatcttataactgtacccataacccctggtaaccaccattctactttttgttaccgtgaagttaacatttctagattccacatacaaataagattattcggtaggtgtgtttctgttcctgacatgtttcacctagcataatatcctccatgttcatccatgtttttgctatggcaggatttttttctttttttaaggtcgaattatatttcaatatttatatacaccacagtttctttatccattcatcatcaatgggcacttagattgtttccataccttcactattgtgaataatgatgcaatgaacatcggagtgcaaatatcacttcgtggtagtgattttgttttctttggatgtatatccataagtggattgttgggtcatacaatagttttatttttagtttttaaggaaattccatactgtatttcataatgactatagccatttacattcccactcgcaaagtgtaagagtctctttctccacatccttgccaacacttcttatcatttgactttttgataatagacattctaacaggtgtgaggtgatatctccttatgttttctatttgcatttgcctgatcattagtgaagttcagcaccttttcatatacccgttgaccatgtcttctttgaaaaagtctgttcaggtcatctgccctctctttgagcaagttgtttgtatttttattattaacttgtggacgttccttatatattttggatattcactccctatcatatatagtttgcaaatattttctcccattgttcaggttccttttattttattaattgtttcatttgctgtgcagaaactttttagttttatatagtctgatgtgttttatttttgcttttgttgcctgcgaatttgctcttagacctgaaaaatcactgcaaagactgatgtcatggagctttcccctatgtttctgttttctagttttatggttttcagtcttagattaaacatttaatccatgttgaattgatgtttgtgcatggtgtagaataaggattcaatgtagataaccagttttcccaagaccatttattgaccaaactatcctttcctaaatgttcctggcacttttgtcaaaaattaattgattttatatgcatggacttatttctgggttttcagctctttctgttggtctctgtgtctgttttaatggcagtatcattctgttttgattactatggttttgtaatagaatttgaaattagaaagtttgttgactccagctttgttcttcttgctcaaaagtgccttggctattcacattcttctgtggctccacaataattccatgctttgttttgtatttctgtgaaaaatgccattgaaatttggaaaatgattgcattgactctgcagaatactttgcatagcatggacattttaatggaattgattctcttgacccatcattttttgtgtcttcttcaatttctttcatctatgttacatagtttccagtatacagatattttacctctttggttaaatttattcctaagtgctttgtttcttttgatgctattataaatgggatttttttcttcattattttttcagttagtttattgttagagaatagaaacatgaatgatttttgtacattgattttgtatcttgtgatcttactgaatatgtttattagttctaacagttttttttgttttttttttttttgcagagtctttagggtttagtagttttcaaaatataagattttgccatctgcaaatagagacagttttacttttttttcttttcttatttggataccttttatttctttctcttgcttaattgttctggctagggcttccattacaatgttgaatagaagtggcaagattgagcatcccagtcctgttcctcatcttggagtaaaagctttcaacttttcacaattgattatgatgttagctgtgagcttgtggtctatggattttatttgaaagtttaatattaagcagggagactgcagtttttcataagaatggtctaccttccaatatacatataaaaatcattgtataacaaggaaacatacctttgatgtctctagaaccttgagaagacacatcttagtgcactgcatgcaataaatatttaagtgtcagtaatattgctatagtagctcataaaatttttcttcattctctaattcattttaaatattgaaaaagatttgtatacatttaaaatatacacaatctacatttacttatattatcaagagtttagctaaactatatatgtaattttagttcagaaattactacgcctataattgtagatttcaaataaattaaatttaaaaagttacattttattttttcaaaataatatcaaaatgataaatatctgaggatgtcttgccctctgaatactcagaggactgctagtgcatttatgcagtctgctgagataataaatatcaaacaatgggcaagtaaagaatgaatctggtaactttatgtaagcattgtaattttttggcttagcctcaaattttaggtgttcttttcaaatcttcattatttcctattctctaacaatatttaatttgttgttttcctgtttaatgctggcactcatcttcttagccatgaagaccatggcttatacgtagcctttattttgttcaggaaagggaaagcaattttaatattgctgccaatgatagactaccaagaaagggacatttgcataaggaggcttttatccttttcttaagtcaagggtcttcggaaagggactttggagccttttaaaaataagaacacacaaaatagatttcctataattggtcttaaaattttataactattctaattaaaatgaaatttaaggaaggaacaataatctctccatataagtattgtaataaaggtagtagaaaattggtgctctgctaagaattttgctatttttgaagttaaggagaaagtataatgcacagtaactttaggttatcctagcagtagcttatgaagcccttgaccctaagagtttctttggctatttctataaaccactttccaccccagcatcatgttgttctctacatcatgaaactctgagtccttgctctattttactacatgagaaattattcagataagataataggcagagatttgtactctccacacagaatggtgtgactttagtcactgatgcatctgaatgtcatgttctattttagtagagtatcccagggaggagaacattatattgtccaaccaatttacctgtattttaagggaaagttttggaagagatggaaagccaaaggagaagaaacattagggaagagaagcgaagtgggaaagagctaaatttatatctcatttgatgcttttgggccttccaaaaaagcccttctcttttacatataataccaacataatttttgattaaaaaacagtaatctttaactacagaagaattttatacaaggaataatagtgattatttcaatagttaatcccacagtttcttattacaaagtcaactctatggtatggatttcatgctttttacaaattggttctatttaaaagcctacaaaggcttaaagtggcattaatatgccactgttattggaattatttaagttcatttaacatcacttaaattgtccatacataaattatatacccaagatatgaaactgcatataaaaaggtttaagtgtagtgtgtatccagcactgcctctgaagctctcgcatctgcaggacatggggaatgttgataatacaaaatattttctatcattttaaaacagttttatttatggatattgcattgcttccttatgttttattctttatacataattttagcataacatttatacccttctctctctgtctctttgtctctctgtttttctttccctttcttttttttcttcctttctttcttctttaattcagaaatagtaattgtgtatatttatggggtaccctgtgatgttttcattcatgtatatattgtaaaaagatgtaattaagctcattaacatatccatcaacctaccaactttttgtagtgagaatgttaaaattctattcttttagcaattttaaaatataacacattatttttaacattgctcaccatgcaatacaacagattactaaaacttatctctagtctagctcactagaagacattatgctaagtgaaacaagccaggcacagaaagacacatactgtatggtctaatttacatgtggcaactaagaaacatagatctcatagaaacagagagtagaagagtggttgctagaagctggagagggtgggtgggtgaggagaagcaatgaggaaagcagagatgttgattataggatacccttctcttttttaatgcatgcaagagtttcaaatgttctttggaatagaactaatatcaaaacccccttcctaaggccttacacctggttatgtcctttttgtttgtttgttttgaagcccactaattcctttctttccaggtaggttcattcttattctgtctctatgcccacttcagaccctatgttgttctcactaatttgatgttacagaatatccacctaccttttgaaattcagctcaaaaaattgtttcttccactaagcaaaagtgatcactgtatcttatttggtgaataaatgcatgaagttattggtgactcatttatcccaggaattatatagatttatttttaaatatttcactgaattaaaataggcttgatatttccttgcatatacgaatgtataattaattgattttcactagactgtaatttaaatgaatataaaggatatattgtcaataagataagtagctacacacagcttataaacatatagaatagaatttataaaatgatggtgagagggaggactttaaaatgcctgtaaaatttagaattatatgtaaatatttgagtgaaaagtttccaatcaaattttatctttcctttgataagatatatgtgctgaccatatttttatatacatgtgtgcatacatgtctgtgattgtgtgtcttaatattcaaagaccattttaaatataaaatgtatttccattacttctccattttggagatgatttaaaagtttgtgacctctgatttaaacaatagtagaagggtttttacatagagtagttaggaatagtattctatagatgatattgatgatatcttaataaataaaagtcctataaataaaagtagaataaattttcatcacttcatctacctaatttatttttaactgtaaataatcttagtctcttaccagaactgaaattaatcctctttttatgaggataagtttgtattggcttattagaaaaatctaattatctgcttatttttttctagctttcaaatgaatagaacaatttatatttcgataattctattttattatgaaatgtccaataagatatcatagtatccagtattttcatattgtgaatatctgctaaatttctttgagatgtgaggaaattctattctgtataacttgtttaggtagcaatcacctctctactccctttctatgaagttttatctcagccccagctgtaggtttagtgtatacttcagggttttccaataagaattcctaatcctctggccatcatatttattttaagtgtatttgatttgagctaggcaaatatctcttatctagagcctttttatctgtggctattaggaaggataccttcactctttctttgggttgctagctatatggctaacattagccgagaaagtctggtaaccattttcttgaaaataaagctactacaaagaaagacagaacttactacttgatcattattcccactgtacctgaatccaactgaaacctggatattccaggtacatggctgcattaatttcctaaggctgaattatcaaagtgactatcaactgaccgccttaaaacaacagaaattcactgtctcagttttgggggttagaaatttacaatcgtgttggtggaatcggctccttcaagatactctacaggagaatcttttccacatctctctcttagcttctggtggttgctgtcaatctttggcattctttggcttgtagatacctcactccaatctctgcctccatctacgtatgcatgacattctccctgtgtgtgactttgtgtatatctttcctcatgtttttatatggatattggatttagaacccattctaatctagtatgacctcatcttaatttaactaattacctctgcaaagactctatcgccaaacaaggtcatatccacaggttctacgtggacatgaagctttgtaggtactattcgacccagcacaggagcaattgtatttcattctacttcttcttttcatgtagtttaatttgacgttctaaaatttaaatcagagattgaatcaacctacattcacaactgaatcttgtattttaagaaatagctatattgcatatattttatcttatctacctatacattgtgcataaagttaatgccacttttgatcattctttgaagtttgctgttttatatatctttatgctttatatttgttatacatcattaaagcactgttatataccccacaaattatattactttgtttaataattattcttggatccatattaaataaaatttagttcaatctgtaagagttaggtgaatttatcaaaaatactaatctttcagtgtaatacatgactcattcgtatttttaaaatagatctttcagtgcaagctgagatacaatgtcaaagcaaaaaacaaagaagggaaaatatttgtaatgttatttctgttaaactatgtagctggataattttattctcactagtgtcaatcttaatttgtttgtgtttaatttatatgcccaaaataaaattattacaaacatttaaaacatatttgaagtgagtctcatttttcccaactgctcttagatcttaattaattgattctgaggctatttttaattttaatttgtatttagtaaagaaaaatgatccaaaagtgtatttttaaaaattttatttttgtttcaaaatctgtatcttgattcgtggtgaatgttaatgcaaataaaaaatttttagtcacttgaatttgatgtagatattataacaaattctactttttactgctacctcatataatagaaatatagtaatacatattaagaatagaagaaacagagatacaaaaactagctatattcaagaaagcagtagttgattacagtgagagctttcttattgatagaatttatttatttacttaatatacctgttacgtaaaaattttgatttttatcatgtttaaaaaaatcaggtgttcagaaaattcatttatattgtcaccataaaacatggtcataagaaggaagcaaacgccagtcttttacttattttagtttttgcaacatagacagggagaagaaattaaaacattaacatataaggtattttttaaaggaaaaatagcattgtgggaaaaatcaggactgataatgtttattgttgtcctagaaaatataaatagtatatttgatgaagtttgtatgtgtgaggttatgaaaataaattacatattaggggaagaaagcaggtggacatttgtctttgccatagaaagacactgtggaattaatattatcaaggacaaaacacctctattagactagtaacaattaatttaatcactcctagacatcacaaattacctgtttaatttacattttaaaactcttattatgtagtttttttcttgatgctattagataatcaccattggatatcaccgagatacttttcacctgtcccttgcacggtacacacaaactatcaataggttctccatcactgaagaatgaacaggcacaattaacaagttttgggaggtcacatgaaaaaacctcttccagctggattgaatggaagcagaaatcatacactttgtacttattatgaaattttattcaatttaagaggaaaatagagatttgtattttctaaaaaaaaaatttaatatcgaggacattgaaaatcacagccagaggtttctgcttctttttgaattgtaacaatccatttatagatgcttgtttaccagtgccagaagtattttagtattttaataacaaacttggataatattcgtaatgaaatatgctatttcaagtgtattaagtggagtaaaactgttttcaaagaaaataagtagccatttatcctaatcacatacattgttaattaattcctgataagatttgcttccagctatattatgtttatgaacaaacagtctttcaggcatgtctcattaacatttaattagtttataaaacactttgctttcctgtcatagttattgtgagattaaagaggattttaattgatgacagaatttttttaaagtttagttaaaaaaaatacagaaataccaaaaagaaaagcagatgacaacaaactaaattaggtgctaataagcagctttgattttcctaagcaaaggtcctcacttttcattatttgtactggaagtgtacctgataaggaaatcagaaggtaggtaattttgtgtatactctgaactttaatgtttggcattaataagatacagaataaatatttaagtttgaaatctgagaggcatatttttaaagcacataaatttaaatacttttttcttggtgggccttttaaagttatttttgaaattacaaaaaacacaaaatataatattatgttaaggctcagcatggggtattgattttatgtcataattatttggatctttatgttgtacttccatgtgaggctttttgtgtagttgagaagtcttacagtcaataatgaattctttgtttaacaatctgcaaacttggaaaaattacttaaatttattaagccacagtgtcatgatctgcaatatgagaattataactaccccactccacagaattgtggaaaatattgttaactgaaataatgacgtaatgcaaataaagtagtgcctggcatatattatgctgtggtctaacctgtttacactataaagctgtcactccttcccaccatgctcctcaccacacttcttattcaataggaacccaatgcagagagaatttttaggaataagatcagaaagttaagataagctaagtcatgagcatgatatttgtacaacttttccattgactcaaccttatataaagcaaaagacacaattgggagtatgagagtctgagatgaggggacaaaaatttacttttagaaactgcagaaagttaaaaggcttagtaaacaaccgagggttctgattgggacactggggaacaacatctttgtagtaattagacttttaaataagggaaataagagaagttcaaataatttaatttcttgattcaattaaagtgaacttctctgggcttgctcctgccaaaagtaaaagaaaactacatccagagcttcaaattatccctatttcttttacgtataatgtcaacactcaattaaatgtaatcaatcacaggagaatataacacttaattgaaaaccaagagaaaaaaatagacaagaaaaacagactcacaggatatacagatattgaatttatcagatttaaattttatattaaattaagtaatacgctgaaggagtcaaataacaatattcaaaatttcagcagaaaactagatacaattaaaaagaggaaacaacatttctaaaataaaattacaataaatgaaattaaataatcagtggatatagttaacagtgaattaagcatagctgaaaacttaatgatatgtcagatgatgtctctatactttagtatggggaaggaaaaaaaggatgcaaaaagaaaaaaaaagaaaagcagaaaagagtgtaagaaacacctagtggctaagaattttcttaaactgatctttaaaaatccatagatttggtcgggcgcggtggctcacacctctaatctcagcactttgggaggctgaggcgggtggatcacgaggtcagaagacagagaccatcttgggtaacacggtgaaacccagtttctactaaaaatacaaaaaattagccaggcatggtggcgggcacctgtagtcccagttactagggaggctgaggaaggagaatggcgtgaacccaggatgaggagcttgcagtgagccgagatggcgccactgcactccagcctgggtgacagagcaagagtctgtctcaaaaaaaaaaaaaaaaaaaaaaaaaaaaaaaaaaatccacagatttaagaagtgctaccgagctaagaaagagatatgaagatatgactgtaaaatcagagattcatagaatccaatattttatccattattcaaattttagaactaattccaaaatgcaggcaatggacatgcttctgtgaagcagaaagtcatctgagacatgaaatgcaggcttcaggttcatcatccccacagcggaaattactttttgaaacctagactagatgaggtttgtaagaaggtaagtgggatgtcacttcccctcacttagtggataatgattagcttatcaatatcccaattttatactgaagcttgtgggagttgaacccactaagctatagattctaggtttatttacttcctaaaatcattagtcagaaatactctgtttagaaccttccatagataaggaccctggtcacaaatttcataagtctactaacccttaggttcacttgaatttatgttgtcaaaggagtagaatgaaccatcttgtttgtttcctgtgggtgcttccttccagtaagagtagcaaatatatgacacaggccattaagacataagtgatcactagaatttgttttacaaaggggaggagaaatttcccctacaaaacatgtaaattgttatttataatccttcatgggtatactgatattcttttgtaagttgagttacaatttatcaactgttacacataattattgaaacttttatatgttggaggcattctattgggtatgtaatcttcataaggccaaactcacttcagttggtttctacagacattatagcaattcaagacttaatcttagcgtccaaaatattttcttatcctgaggttatggtatgcacaactcagattttcaggcgaaataacttaaaactctgttaccaggtttctatgacaaatagattagtatttttcacactatatgtcagttaagattacagcaatatatttcatcatttcccaacagaagcaaatttttccatattagcaatgacgggagtgtgaacagagactttttttcagctaatcctatattctatctggtttgtggacatatctatattccagatagcattgtataggtttttcatggacaccagcttctgtgtcatcataattatgtaacactgtccatctatcccccaagaaattacactgagtggttcccttttccttcatttctatcctcttgcacaacaagttccaggatataggtaatagcataaaataaaaagaagatgcaaatcattccaacttgaggtgtttgagtcattggaaaacaatgaaagccatagtattcgtgatgacttaccaaaacctaaggttaccaaagtttccccgtaggtatatgtctttgacttggctctgtaaggccctttaccagaaagctttccaaaaaaaatcaaatttcattgtgatttgaatatctaatagttatccctgggggaggttaggactactcccagaatagttcagaagtgaaaatacaatcattattgatcattctattctattaaaatggtgttatctttctattgtgagagccgcttctaattccctttagtttaaaaagttttcccttcaaaaagcctctagtaatattttttagcctcatttagtatagcatgactaactcctaacgtcttcactaaactcttgctatctcctgggcagctgctgaacaagttacctcatattctgtttcattgtacatttaaacaaccgtacaatttaggaaaatgatctgaacatccaaacattggatatctaacaactgtcaatggttttttttctacctccaaatatagcttcagctgggtatactaaaaggcttcccataaaagtttttttttttttttgtctgcttctggagggaaaatatctatcctgtcagatctcacaatcacatccatgcctaacatctttgaagttattcaggttccatttcgattttatttagatgaaatccatgaaattcacttttaacttaatcaaacgatcatacaaattgggacatactcaacaggcagccacagtttgctttatatcacacccaggcagctgtttgaatcatatattgtcttgatttatgatctcaaggatgacagaagatcaactccacagcatctttcactttatcccattgacttgaccttgagtcatcagagtgtgctacataccgtcttttcctcagattcaccaggtagaatttctactgaagatcagtagaaatccaatctcctttctccagaggtaaccagtttaggatttctctcagcactggctattactcagtaccagatctaagaaagagcactgagtttattctcttgctctgcaaggctaatatggggaattatgtaactacatccttccttgggattagattaacttgtgactgtctttgccatctacatgtcttctcccctttttccacatttattacctgttttgacccagactttttccccataattggagtttctatttcagcataggtgctacatatctggtaaaataacaaaaacaaacaacaacaacaaaaaagaaataacaaaacaggcagtgttatttggcaatggagctgccttgatgcttcaaggcagtaaagatactgctcacctacaaaatgcctttaggaatacgaacaagcaacttcgaagtaatcaatattgtgtcttgagtattgatttcagcttttctgataaaggtaagtttaaccttgagcatagaacactgtaccaaacaaaaaattgttatatgtgtaggatgcacagtttaggaattagatctccatttgtcactttctgttcaaaacacgcttccattgtgaaacaaagattttaattattcattctaattttcaatgaggcttctgctctgagattgttaagtaaaatttgtgtaatattgtttccctgttttttttctattttctactttcaaaacagtgaaatgcatactgtaccgtgattcagagaaaaatatccagatgggctaaattgatagctaattctttatttgaaatatttacttgttttcatggtgttgctccagacaacatgagtgaactctacaggaaaatagagtttgatcccaattaatactcacatatcatattttctgcctactgatagaggtctatagtcatccattaatacaatctggtttgaccaacacccagtaagactctagccatgttttacttttggcttttaacagcagcttcctcaggcatttttggagtaaaaatactaagaggtattcactgagcatcccatttcaatatataccacagatgctggtctgcaatgttgcagttgcagatatttctaatgtcaactaaacaattgaatcataaagttttatgtagactgtgccactaatctccaccagtcttttaatgattatttttctttaggacctctcttaaattcagatattttttctattgattttgtgaacagggcttggaaggattcttaaataaaaaatattatcttttcaaaacctggaaaatgggtagtctctgagcttcatgttgattggcagaatctgtgcaagagaacaatgtaattctcacaatttgaagaatacgtctggttgatccagtccacttaattctgagaaagtccacagactggatcgggtcttggattttagctggattcattgactgggctatatttgtcatatggacaactacagtccttaactcttcctgagctgagcagaccctgtcataaatgggtttctgttccacatgaatgaaaattgtgcttgactgtcctcctgcattagaatggaagataagttattatccaggttttcaagggcatgccagttccccttcacctattgttgcttcataggctctactgcatcaaatacaacagaagcaatcagaggaaccgtattgtttaatctttaatagtctatcaaatcccaggaaacatgttccttgtgcattggccagaaggagttatttatatgggaagttagtgaaacccctgtttcacccattcccttaaacggagcagtgatctcttgttattctcttgaaattctgttgtgcttaatatttacttctttagagggcactggtaattttcacctaacatgtctagttaaaactggaagacaagtttatgtaatcatcccatgacatgaattggtcaattgaatttgagtaaattctctgcacactaccccagagcagaggtgccttcccctttatgtctgttatgagaatggacatgtctcataaatagagcttcttttctctggttccctgaatgtgaagacccagagcgccacctggcatggagtcatagctcatctacagcctacctataatttgagcaacacgtatagctttctgttgaaagctactgaggtattggggccatttgttgctataatggtattgattaatacactatcttatgataaatctcaacaaatagagataacaaaggcaaacatttcctggaaactaatagtttccctggattattctaaatatattgattgcattgatgaaccacatgtcttatcttccttggtatggtgatgctaagttttctattactgctataacagattaccacaaatttcgcgacttaagaaaactctgcaaatttattatttcacagttctgtagattggaagtccaacagagatctcactgggctaagataaagataacagcaggtggcgttactttctgaagactaggaaaaaatctatttcattgtgtttttccagcttctagaggtggtgatttacttgtctcatggctttgttcctccatcttcaaaatcagcaaagtggggctcaatactcatgctgctatctctctggttcttggactctctctccagcttttatattctaatttcaagagcttttatgatcacattatacctataaggataaatcaggataatctcaatgttttttacttagtcacacctgcaacacgctttttccatgtaagctaacacattcacaggttccagagagtaggaagtggacatatttgaagggtcactattctacctattacaataccattgtctcacgttttctccttcattggagcaaaatggttattaatatatggtccccaattcatctggagtatcagtaatatgtgtgaatagaaataccttgaaatttgacctcctatacaaaatgttctccatctttgtcataacttctaaaagatctaatgagttaatctagttcattctctgcttggctgacccatgatgactcacctttgtttgattttgcattttaaacatcttttaataatgaatttcctttaactgttccaatccaaattttaaagctttagggatataaaacttcattttctcataaaaatctcattcttttcatgagtctacaataaatataaatattacttttagtgctaactaaacactgatgtgttaatgttttatgtagctatatatattagatatcctttctaaatatccatcattctctgttactgaaagactttgtattgcttctgcggcctgagccccaatgataacaaaccccagtggattcttctgcattttactgagccagtgtctttgacattgatggcttactggtcagcacagggaaacgactgacaggcttatacacttgtggaacctgatgaatacagcatatgccacaaaagtcaatgctgttaataaagttggcattatgcagtaatgcgcaaatctatgtatcgcaacataggattaaacattttagattgagacagaggctgctgatactgatggaatcggcttgagaaactcgtcaaaattagaaggattagatactaattactggaagaaaatgaaaaagatccatcataatcacttgctggtactcttattttaactatactgtctttctccctcaattctaatccttatttatttacaacataaatgtatgcttttatataccctaagacttatctaattacttgtaaataaaagtctgtcttttcctcagtgcctttttgggaaaccaattggtgtatattgcattagctgacctctcacatattgagtcttaaatcaattatagttattatcattactgtctcatcttcttctatttcttctaggatattattatattaatttgactgcttattttcatgttaatgctataatcatctaaatgcttttcctcctccctataaataccttatggtttctttaatgaaaatgagaacaacaacaacaacaaaaaaaaaaaaaaaaaagggaaagaaagacttctacttctgtccgttaagtattagctgttaggaaatttgccattttgccacaaacaactgggaaaaacaaacaaaaactcaagcaagagttttcagacattgaccaacaggcagtgcagggctataaaccctgacaaaaagaaagggagccctattattttaccagatttcttcccagcttcattttccaagggatagctcaggactggagaatcgcaacagcttgggaatcagaatttgagaggctgatgaagaattcctgacaaaaggtttggaaaggaggaagctacataaagagaaagaaaaagagctatggagacttatattgaatctttggatggtgaaaggtgcaaatgtgagaggacaggaaagaactggtggaaacaaaggccaaataatccacatcaggctggaagttcacttctcagcagcaaggttggagagttctatgtcgcacagagattgggcataaagacttgctcttgaggtgaggccaaatagtcctaaagatggctctgggcctgcgataaaaaaagcctaacagtggggctccaaagaggaaaattgatcctcaaattgcataacagtgtgccagatcaaaattcaaaagtattttaataaaattcaaaaaaatgcaggactcagcaaccaaaatccacaatatgagatgtccagtcaaaagttataccttagtaaacttaacaaaaaaagtactaccctgtcaaataggtagaaatatataacctattttatcagtagagaactcagtcaatagaatcagatgaaagactaacagatactttaacaaatagataattttcttaaaatggctattataggttttaaatgttcaagaaggtagaagaattcttggacatggtgaacagaaaaatgaataacttattagtttcctgtggctcctatgacaaattaccacaaacttggtggcttaatacaacagaaatgtattctctcgcagctccagtgggcagagtctgaagtcagtttcactgagccaaattcaaggtggggctacactcccataagaggttagaggataatctgttccttgtcctttcccatatctgaagactcctggcttttattttattttattttattttatttttgaggtggagtctcgctctgtcacctaggctggagtgcaatggtgcgatctcggctcactgcaacctccgcctccctggttcaagcaattctcctgacctagcctccagagtagctgggattacaggtgtgcacagccatgcccagctaatttttgtatttttagtagagatggggtttcaccatgttggccagcctgatctcgtactcctgacctctgaagatcctcccacctcggcctcccaaagttctgggattacaggcgtgagccaccgcacctggctaactgctggaatttctttccttatagccgtatcacctttatcctgcctctgcagcacattccctactccttttctgtacaggtatcaaatttccatctacctctctcttatgagatacttgtgatttccagaataatcctgataaaccagaatactctccccatcttaacatctttaacttaattagattgccaaaattccttctgctttataaggcactattcattcacaggttgcaggaaataggacctggtttctttggaggccttactgagtctaccacagataataagaaccacaggaaacttctagaaatcaataattaaatgcatacagtgaaaaatacactggaaataaaagcagattgtaactaactgaagacagctttcacttgaagacaaacgataaaacattcaaaatgacaaatggaaagaaaagaatgacagaagtaaacattggtaaacattgaccaatataacagagcctaaaatatgttattggagtcttagattgaaaggtgggtagacagaaaaaaaaggttaaagaaataatgcccccaaatttacaaatttaatcaaaattgtagacctagaaatccaagaagttcaatgaaatttaagcagaactaatatattttgaaaaagattgatcttatatgaaatttttgaaaaccagttataaagagaaaagtttttaaatgcagaaaagtagatatacaaatgaacaataataaagatagaagaaccatttttgggaggccaaggcagacagacagcttgagtgcaggagttggagaccaggctgggcaacatgacaaaatcaggtctctactaaaaatacaaaaaattagccgtacgtggtggcatgcacccctgtagtccaagctactttggaggctgaggtgggagtattagtatgtatttgttaaaaacaaggacattaatctatataaccaaaaacaccataaaaattagctaattaacataaattttatctaagcctgggatggatctatatctcagtatgccttttggagccaaatattccagctgaggacccaaaggtgcattgtttccatgacattttagttttactcagtctgataagttcctcagtcttttcttgatttttatgatcctgatattttgaagactacaggctacttacttgtaaaaggtccctcagttcataatgtccaatgttttattacaactagatcaaagtcacgcattttaggcaggattatcacagaaataccattccaaatgttgccgcatgctcattgcatcctatgggttggcacaatatttcactttgctctgtcactgataatgtgcaccttgctcactttattcaggtatttcctgtctgccagacttcttcactataaagttatgcttctgtctataattaataaggattgtctgggagatacattgtaattatgtaattctcaatatctcattaaaacttcaatttactcatttatttatgtctgtatgaagctgtgatttcctgtttaatgaattatattttatattatcatcattatttattttgatgctcaaattgccccagatttggtcagagaagtcccatttagactagcttttgtgtcctttttcatatccctttgattcattaagtatttcttttctttttcgtacaaaatattgcatgttcttttgtattttctttggcccagtttaagaatcaactatttctccaaggtcctctatttgtttttcataaaaaatgttaagttgaggcgaatgtatagtcacgaaatgtactggcttttattctaattatgccaatttcagtgagcataattaggcagtgcatgtgaattcctacacacatattcctaaacatgcatgtgcatgttaatatgtatatttattttttgacctatctttctatattaaaagtcacacatttatactttcatatcccatttctatccaaactacaatattattctagattttcctctttctgcacttacccttctcccaaatgcagactttcctccctgcacctaggttccagagtttcatcccaggatgaccttctcaccctgcttgggctctgacatcctacaacagagtacccctctatgtgaaagctctcctgaaatttcttgggctctaacactccactccaggccactcacaggcacacatgaccctctcaggctgatcattctctggcagcccccattcacagctgctctcctcatcccagtgcgactctttgcctcctgtgtgaaccttacttcgcttcactccacttactctctagcatcccttgctgaaccatcctagtgcatggatgccccacttatctttttggggagctatgattctaaatgcccactttacatgtagttacccccactgaagataggcatgctcctctccttgatcaggttccaagcactcctgtcagcctgcttctctgtgtgtatgtcttgtctcccttctttgactgtgcctcctatgcctggccttctctgccctcatagaaacctgcctcagtccacctgggctcctacagggctcagcgccactgtgctccctacccccactccaaaatggctgcctatcttgctttctcccatctaatagtttatatctgactttttcagaaaaggaaggtaagacagctaagaaagggaaaaataaaagaaagatgtatttttgaatctcaaattaattgttctttgtgcttctatttctataaattaatacaatcttcccaatttttcagggttccagttatccatttggtaaatatactgagtctctattatttgcacagcatttgagatgtttacttaaagatcatgaatttgttcatttgaacaaagaaaactacttccctcagatcaaaatttaggatttaggatctcttgtcaagttgcaaaattcagtaaataatgtagccagattaggacctaacatttcattaatatcaaatcaccatgaatactcattcaattatcatctattaattttattttctgctggtttacgtacctgtatgaaattggttgttacaaatttggagtaaattgtgagctagaacttatttgaagtaatatggattcctatatattctttcattgaatcactatgtcttttagcttaaaattaactctagtatcatgagtatcatgatacacacacacacacacacacacacacacacacatacatatataccctgtatgccagaaatggtaacacagtttacaaatgaaccttattacgtaggtatttttattatcacatttagcatatggaaaaactgaattgtggaaatgaagtgatttttctaagctcacagaccttgtaagtgatgaggtaaaaaagtaagcctgagccagtatagttacttacttgagattcttaatctttatttttcatgttctgactccccatccagatctcattagaagttgtatttcatcacttttctttatacgttaaacatatcaaattgtgtgtattacatacaattccttttttagtgtggctgttcccattgtttagaactttcacattgcagatttccatcctataatttctgtctgtaattaactcagtcttgttcctgaagatgcaggacaggaataatcagttcattttcaaaggcaacattgatcactgatctactttcagatttgaagttataccacctatacattcagatatgtatacattcaggcaactacacaaaatttataaaatgaagttttatacttttagtgtattttttattagttattgagtgtttttgtgaatttccttctgtaaatctacaatatgacccttagtttggatgggaatcgccaattcaccttagtttcttcttgattatgcctatggcagtgctttaaaagagaaaatgtttatttattgtgtggtaaattaacaaacaagtgggcttaatttttggaaagagacaatctataaacctatagagcagaatggtcattctgtaaaaattcttagcagtttatacaaaatgttcgttccacaataaatattgttgatatactttagattatctttaactacaatgagtgaatgtgttgcttgttttggctcacatattctaaatattctttatctgaggaacatgatgactttctttagaccagtggtttaaagtgaggaagtaaacctgggggtaaatcagtttacgtgtactgtccaagacaaatcatttattctgtgtgataaattttaatgcaaagatgagcaactgatgaacacaaaaatgagatcattatacatttgtgtctgttttcactctagaataatcaacttgccctttgcttgtgaacacagcctaaaattcagtgagagagtaccagtgtgcagttcataaagaatactccaaaataacagtgaatggagttggtgatctaagacctttgtgatgaaggagaaaagtccccattttatcatatgtgtctgaaaataattattaatattgctttcataacctagattacacattttttaacaagtgctgtagaaacagcaggatatgtttctatacaatttttcaaatatgtatagaaaacatgacaatatgtttgatagaaatttaatgcctggtaatttttattctatatgcataggataccataaatggtagttaacgtagttgacgttttcgttttctatatgtcactggattttcaatttgaacactacctttacttttgcttctcagctattgtgttttcaaatttacttttttccttctgaagtaataaatgttgttcgctgatgctttgccttaaaatggcaatgatatgttagcaaaacgaggctctgtatgtgtaattgcataccatgtaggtaccttatttatactgcatacatagagacaggacttttacatgcatgccattgattttagggttatgataatcatatttttatattttaacataagcaatgtgttagccacaatggctcttgacatagagctgtccagcctatacctatgtacagatgacttattagagtaaaaataatatttataagaatctctcttgacagattatataaaatattttatatctatgcattatatatatgcaccatgttataaaaaataatctaattgcagaaagatatttagattagtagttctcaaattttgatatttggaccagcagttattgccgtaagcgatgagcttattagatatgcaaattcttggaccatactaatcccaaaagactgaattaatacttctaggaatagagcctaggaaactgcattaataagctttccatgtgattctgataaatgataaagtttgagaaccagcagtgaaaaatctatatctattatatctacccatctaatctaatctaatattcattaaacaatagtaaaaatatggatgcacattttaatatacaaataatttttgtttataaaaaatttcaacattatatataaatataaacctccatagagctctaattgctgggtcttgtgtctgctctagattgtataaacatagctgaaacctcttgggaaagtaagagtgatagcagtggatcatgttggagaaaatatggaaggcatgcacctctcatgcccaggagtgtgaaaggagacagaggctttaaaacattcaggatcttgcactactggagatgagaataaatggatcacctgtaagagtcaccctgtgttacaaattgattcctctgtaattattctcaagaagactcagcaaagactgacacacatacacagtcatgtacacacacacatacacacagacccatacatatacatatgtaattttagttgagtttaacaaaagcttctagaatagtcacttaaacttttaaaggttaatctatatttataatacttagatatgtttgaagcattcacaaaattttaaaaaactttttttaattttggaaaagagcattttcaagagaactggaaaaaagtgaaaaatgttcccatgtgaacttcacccagtttccccaaatgttaacattttggggtacatttatcaaaaccaagaaaataacattggtacaatactattaactaaactacacacatatttgatgtcacaagtttcctcactaatagctttcttctgatcaagatccaacccaggatatcatgttgcatttagacttcatgtctccttagtcttctccagtctgtggcagtttattgtgttttccttgactttcatgaccttgacatatttaaaaatattggtcggatattttatagaacgccccacaatttgggttcatctgatgcttcctagtgaatgtactggcattgtgaaacttgaaagagaatatcacagggcaagatgcccttcttattgcattatgtcaggggtacatggcatcaacatgctttattgctgatgctgttaacttgattatttaggtaagtttatgtctgctaatttgcttttataaaattgtaccatcattagcttccctttctatgttttatttcttagaataagtcactatataaagtctacattcaaggaaaaagagagttaagtttcacacgctggtagaaaaacattaatatttgtgaaaacatattaaatataccatggtaatcaataaatattttgggctatacaaatatcctatttttcttaaagcttttccaactaattttagcagccatccatagatcttcattattaggttggtggaaaagtagttgtgctttttttttcattgaaagtaacagtaaaacagcaattacttttgcaccaacctaatattattactctaaccatgactgtagtgttcagatgacttttaaaaatttcttcaacattaattcattgacattcatttgtaaaacagatttattctttcttacttatttattcaatcattttaatatcagggtgtgctcacctatgttatttaaagttattactttggttttaatgcaatactattataattcattttgctgctcacatgttttcatctgtggttattggaaactccttcaagttgaacccgacccttttttttagcacttttttgttactgcaactacatgatgctccaggtttaccttgctttttttcttccccaacgctagaaccaactgctttttcaaaaagccatggtttcttttattgcaaaatggtatttagaaaccaaatctgggtggtatgtgtgttcattgcaactggagtatacacctctcagaggacagggaaggaaatatagatatctgtattcataataatatgtttatactaacccacatatacatgtttctatatttatttctgtatttcttaaaataaaaatgagttcatgctaatattttttactctaattcagcaccacagagtttgatcaatatttcctccattgtttgagtatttgtaacttctttctcttgcagtgagaaacctggttcccgttattgataatttatgtagttatttgttcaaccctagtataggtataaagggcttcaagaatgagtaatcatattcctgtataaaatacatttaccaactagattacagtgttttaatgcaattgtttttgcttttacctttacaatatctcatcaaggtactcctttccaaatttacttagttcagctaatttttcctttatctctttaagtgtagtatataattataaatcaaatatagttaaatttatttgttactattttagaataattattataaagttactgttgtttattggtaagacacaagtatatgtataaaaagttactttccaaagataaagtggtgctgtaaaatacatttatttacttatatagaatatttctacactaattaccagatcattttacttggaaacgtaggtctgaagaagaaaattaatctatgtcactgaaaagaaagcattttattatgagtgagactacatgcagtttcaagagctgtagctagttgtttcatatcctgtgcactttaaatacaatgtcacgtctgacatttcgaaaaattttctcacttagcagctggtaaaagcaactttacttaatagtaggtttagaagaaatccacatagtgagaataagaagaatctgattatttcacttaataattgtataattttagatagataataaattaacttctctgagcctcagtttgattatcactgtattaggaataatcacattacccttataagtatctaggttattatttcttaactttggcgccattgacatttcggacagaataatcgtttgttgcagggttgagtgggggtagagacttcctgttgaatcatgtgatatttaacaccatctctatcctctacccactatgtgccagtggcacaaaccacttctccaaattgtggcagtgaaaactctctctagacaattgttttcctgggaagaaaactgcctttatttgagaatcactgatctagttttatgggcaaaacaaataagtatttgagtctgatgagaaaggcaatggttgaaaatgaaaccaatacccctgagataataaaatatcatctccattaaacctttaaataataaaattgtgctttctaattcttctgtagccaaaataaaggagtaaaccagaaaattactagggattattatttagaaattttttaagatctcaaccaaaaatttttagaggattttgaataccaatgggcttattagagaagactagatatggtagtctccatccacccttctcctcatttgggagagacattttcaatacagtgattttaatgtaagtaccacaaaaagtggaggtatcacattacctgacctcaaattatactgcaagtctaaagttaccaaaacggcatggtactggtataaaaatgggcacatagaacaatagaactgaatagacaacccagaaataaagccacatgtttataaccaattgacctttatttttttcaacctttattttaggttcaagggtacatgtgaaagtttgttagataggtaaactcttgtaatgggggtttgttgaacagattatttcatcaccaggtattaagcttagtacccaatagttactttttctgctcctctcccttctccctctctccaccctcaagtagacctcagtatcttttgttccttactttgtgttcatgagttcctatcatttagctcccacttgtaagtgagaccatgcagtatttggtttcctgttcctgtgttagtttgctaatgatatcttccagctccatccatgttcctgcaaaagacacgatcttcaacaaagcgtacaaaaacataaattgggggaaagacaccctgtgtaataaatggtgctgggaaaacttggtagccacatgcagaagaatgaaactgaattcctgtctctcaccttatacaaagatcaactcaagagggattgaagatttaaatgtaatacatgaaaacatagaaattctagaaaaaatttagaaaaacctttttctggacattggcctaggcaaataatttatgactaagatctgaaaagcaaatgcaataaggacaaccataaataaatagaatataatcaaactaaaaacttttgcacagcaaaaaaataataataatcagcagagcaaacagacaaccaacagaatgggagaaaatatttgcaaactatgcatctgaccaaggactaatattcgtaatctacaaagaacttaacaaatcagcaagagaaaaacaaataatcccatcaaagaatgggcaaatgacatgattattttgtatcttctgtagagaagatatctgtagagagaagatattctgtatcttctcaaagcaagatacagaaatgaccaacaagcactaaaaaaaacctcgacatcactaatcatcagggaaatgaaaattaagaccacaataagataccaacttacccctgcaagaatgacgattattaaaaagtcagaaaacaatagatatcatagatgtggtgaaaggggaacgcttatacattgctggtggatatgtaaattagtacaacctccagggaaaacagtgtaaagatttcttaaggaactaaaagtagattgtcatttgatttggcaatccactgctaggtatctaaccccccaaaataagtcattgtatcaaaaagacacctgcagatgtatgtttattacagcacaattcacagttgcaaagacatggaaccatgctaactgcccatcaaccaatgagtgaataaagaaaatgtggcatacatatatatatgtgtatacgcatatatacagtgattttaatgtaagtatcatagaaagtggaggtatcacattacctgacctcaaattatactacaagtctaaagttaccaaaatgtcatggtactggtacaaaaatgggcacatagaataatggaacacaatagacaacccagaaataaagccacatatttatatatacccagttgtaacaaagaatgaaataatgtcttttgcggcaacttggatggagcttaaggccattattctaagtgaaattactcaagaatggaaaatcaaatatcatatgctctcacttataagtgtgagctaagcttggggtatgcaaatgcatacagagtggtacagtggatattagagactcagaaatgggaagttgggagaggggtgagggataaagaactacatattgggcacaatgtacactactcaggtgataggggcactgaaatctcaaactttaccaatctgcaattcatccatgtaaccagaagacagttgtacgctaaaagccattgaaatttttttcaaaaattgaaattaattaattaattttaaaaatgcagacccctctgtaaaagagaactgtattgtgagaatgaactgaaacaatatatttaaagcccttagcattattcctggcacataataaaatctcagtaaatactaacttgtgccaaaaataactgatagtcattttgttatttattaacatatatttacttatatgcagtaaaaaccaataacaaatattttttaagtataggaaaaatactcataagagaaaaagatcacgactgacactattataagcataaggacctaaatatagcaaagtataggaaaatactcataagagaaaaaatcagaactgatgctatttattataagcataaggactttaatatagcaaaggaggatttaatacaacatttgcaagagctggtggagcagaggagacggagcctctcacccataatatcagtcataaacatttaaacaggtgcttctccagagtaacctagaactctcccaaaacagcagtctactctctcacaagtgtgcagttgcctccagctaacagtaacctccccaaagtctgctgcctccaagtcttatctgactgcatcttgttaacaaactgactagaaactttctggggaaaaggacactgggaatatgattttgagttttccttatgaatagcataaaaagtagagaaggggaattacaataaagatgcttcaagaacagagaaccaaaccttgcctgttcatttactaagtcagtgttcattcatgccactttgttgttgttgttgttgttgttgttggagatggagtctcactctgtcacccaggctggagtacagtggcatgatcttggctcactgcaacctccaccttccaggttcaagtgattctcctgcctcagcctcctgagtagctcagattacaggcacgcaccaccatgcctgggtaatttttgtatttttacttagacggggtttcaccatattggtcaggctggtcttgaactcctgacctcgtgatctgcctgccttgacctcccaaagtgctgggtttacaggagtgagccaccacgcctggcctcattcatgccacttttaccaatatttaatttagtaatgaaaggatcagaaccatgcttctgcctaaaattaagtagattaacctcatacagataaagacattcttagtctctaggctgtcgccacccagatcacaccaggacttgaccttcaaaagctcttccactcttgtactatttatgccagtttattggggtaaggagacattagtaacattagtaaattaatgggcatgagtctagtgccttactccatcacaatataagctccttggtcagaagtaatgctatttggaaaacaatggtgataaatgaaatatccttcaagtactgaatgggcaggaagaaaaattcgtatctgtagaaaatttgtagtccagtgaggataagctgctgcaccgtatgttacaaagcattccaattaaataaacttgccactgttgactgtcatttgccctaggggatgctgcttcaagattaccaagagcctcctcagcaggaatgccatttgagagctttcctgtcatatctcagagaccccagattttggagtacacactgtaaaaaagtaccgacatgtaactgtgacaacttgcgtttctgttgtttcaaatagtcccaggaagaaatctagctccagcaaaatgaaaacccatttgatccagagatgcctgagttggagatgaaatttggtaatctctccacattaacatactaaaaactctgcccagggagtagcttgttggccattttcaatagacgtgatgtatgaagaaccatgatcgagaactatgcctatgtggcctttgcccagcctttacatagaataactcagctaaccagtgcaacaaaagctctgctatgacctttgtccagagaggcactgccttgggaactatctcaggtgttctccctacttgtcaaatcctcctcgattgcagtcattgggctgtcacctgccaagtgactaaacccacccattgtgtatgtaacaccctggacacagatatcttcgtacccactcttaaaagtcaaagaaaatatccttttctcaaaagtgttttttttttttaccaaatttttaattatgtcacctttgtgtctcttattgtgatggctaattttatgtgtcaacatagctgggccacaatgcccagatatttagtcaaatattattctggatatttctgtaagggagatttgtggatgagtttaatatttaaataagtggactttgagtaaagcagatcgtctgtgatgatgtgaatgagcctcatccaatcagttaaaggtcttaatggagcaaagactcatgtgccctgagcaagaaggaattctgccagcatatgcccttcggacttgaactgcaaaattggctcttccttttgtctccagggtgctgactcattctgcaaatgttggaattgtcagccttcatagtcatgtaacctaattccttaaaaatctctctctccccacacaccctgtgttggtttcatttctctggagaacactacttaccatatagacagtgaatcagcatagatctgtattccattatgccttaaagggcaaaattaaacacccaggtatgtttctcaatgttctgcacactgagaggatttcccttcgttgtccttcaggagccaactgagtgggattgtgatactgcaaccctcccctttgtaggggttctaccatcttgagaaaaccgtattttaataagcccttggttagatatggtacacttgtcttctccttttgtttattatcttaataatatctactaatgaacaaaaattcttagacttaaaatggtccaatgtatctttttttttcatttatagttagcattttttcctatttaagaaacatttgctactttgaggctataatgatatttttctatattctgttaagtagtttgcaggtcctggaaatgaaagtgtgtggaattaaagcaaactccttaaaaaaagtatgaaactgcacacacttatttgaaagaaacatttcagtgcactagaaatcaactaaagatgagaagttgagaagtgcttacaaatgaaaactgctagtggaaagtttgtggcttgctagcctgaatgcattcctattttgctaactcaggtttacctccacctcaggctacaaaaatctgcccgttttttctggatgaagggtagagatcccttttggggtgaatggtagagccactaaaaaattattttggaagcaagagggccatagatagattgagttgataagctgtctctacatctctggttgactggtaagttacaaatgcatgccagaaaccccaaatacctagagaaaactggaagcctgaggaaatttgcaattttgctgcaccttcaacccacaatcagcatagggggcagagagtgtaaatcttacaagatggcataaattatcttaacataccactgcttaagtgattttccactaacctattcagacaaaatgcagacacctagggatggcaggcttatgcaaaacaaaataaaacaaagcaaccagtagttgtacattgtggggaaagagatttcatgttgggaattcaggcatgattattgcttaaccaaaaggaaaataattaataagtcaaaaataacagatgctggtgacgttgtggagaagaagcaatacttatacactgttggtgggagtgtaaattagtttgggtggtgattcctcggagacctaaagacagaaatactgttcaacctggcaatcccattactaggtatatatccaaataaatgtaactagtggccaggcgcggtggctcacacctgtaatcccagcactctgggagaccaaggtgggcggatcacgaggtcaggagatcgagaccatcctggctaacgcggggaaacactgtctctactaaaaatacaaaaaattagccgccaagattgtgccactgcactccagcctgggcaacagagcaagactcggtctcaaaaaaaaaaaaaaagaaaagaaatataactagttatgttaaaagatacatgcacacatatgttcattgcagcactattcataatagctaagacatggaatcaacctaaatacccatcaatgatagactggataaagaaatgtggtacatatacaccatggaaaaaaaagaacaagatcatgtcatttgcaggaacacggatagagctgaaggccattatccttagcaaatttattaaggaacagaaaaccacacacaacatgttctcacttataagtggaagataaatgataagaactcacggacccatagagggaacaacacacactggggcctcatggaggatggagtgtgggaggagggagaggatcaggaaaaataactaatgagtactagccttaatacctgcatgatgaaataatctatacaacaaatctccatgacacatgcttacctatgtaacaaatgtgcacatatacccctggaattaacattaaagttttttttttttttcaaaaagaaaatcaacaacacttatcctatggtctcaatgtgtgccccgcctcaaatttacgtgttgaacttaatcatcaaagtggtactatttagagatggggcctttaggaggtgattgagtcaggagggtgggccataacaaatgagattagtgactttataaaagagctggagggaactagctgggctctgtgtacaattccatctcttttctcatgtaagaacacatcattcttcccttccagcgtgcacagaaacaagccatcattctcagaagcagggcagcttcaccattttccaaatctgctggcaccttgatcctggatttactagcctccagaaccgttagcaaataaatgtctattgtttataaattacctactctgctgtattttgttgtagcagcaagaacgaactaagacaatttaggagaacaaaacagaatccagagctgcctcaagataaagagatctacctttaccatttctattaagtgatttattacaaatttcaggtagtgcaacgaagcaagaaaatcaaagacatacagattagaaaggaaaatgcaaaatctttatttgcaggtgatgtaactgtgaaaattgacacttctaagccatctataaaatagttacaagaattttatgtgattttagcaagggaatatatacctattaaagatagagactggtatttaaaatcaattgaatttctctctactacaatgtaaacgttccaaaacaatgttttaaatgttctgttatgcaaaatatctagaaatacatttgactcaagataatcaagacctacaaattattgttgagagacattgtgcaagagaatacaataaataaatattacaaactagtagggttgattactacagagagttggtgggcactgggtagaaattgtgggaaaaggaatggggtaataggcatctgagaggacagacacttcttaggacatttcttggactcttatgcctctgctagtaccatggtattgtgtcatatatcccaaagtaaataaataacaacaatcaaccagtatatggaggaaggactaaaatggaatacaaacagtaacacataacctaactgtttatgaatgaataacataactacactcaacgagttgggaaaaaagaagactaacctaagtgatgctagaaaacaatatttttaccatattgtaaagtcaaacacaaagtgaaatataaatatgtactgtagttagaaaatttgatcctcacaggaatatgagttagcaattctgaaaccaatttatgtgtgcacttgggttcaataaataagaaaatgtattgtggctaatgagagacaggtttctcactgccaagaaaacaaatagaagggtggaagattagaatgaaccctatggtgtttcactaggattagaggtaatcgttcatataaatgttggagagatgcacaaatcaaatacatgtatgtatatgtatggtagtatatatacatatattttctagctttaactgctaagactagaatcaatgagtaaactcaggactcaggttctgtctctaaacaccatcatctaatgaaaggtgccgggactccttgaagacgtttaattccagcgccagggcaggaaaagtccaagaggaacctgtaacattttgtggtgtcagaaagtaggaaagtgcttataaactatggggcatgttgaaaggacacaagagcgacactgagagagtttctcatggcaaaaatggaatgctgggagctgaaatcatgaaaatattagttataatctataaaataatataaatataatttaacccatactcaactgagtgaatgaataaataaataaattgataagacagaacaactcttccttagagtgaaatttcaattactacaagtagaattaatgaaggtaataggtcaccatgaggaaaacacttcagtagtatatgttatcagcaaaatctaatgggtgtcaaaattctttggagaaagtgtaatgagaaacttatatttatcaaagtgtctccccacaaggtacttattaaagacaagcacataccagcatatatatatatatatatatatatatatatatatatatatatatatatatatatggcacctttcattagataatggtgtttagagacagaacctgagtcctgagtttactcattgattctagccttagcaattaaagctagaaaatacgtgaaatgtatgtatatatatatatgtgtgtgtatatatatatgtatatatatataactatagtggatagactcagcagacaccacttacaccaactatcaaggtgataggacatattggcctcatgggttttctattagaatgcactgagaacagagtgccacatctatagcattcatatattgatatcccaaattcataactataatctcagtgtgagaaaattttgggctatccccaactgaatatctagatactccagaattattaattgaaaataatatttttccctattgaattaccttgattttattgaaaatcagttgaccacatatgtatgtgtatctatttctggactcggttctgttactttgatacatatatccacccataagccgttaacatacttgcttgattattgtagttttgtttatttatttatactttaagttctgggatacatgttcagaatgtgcaggtttgttacataggtatacgtgtgctgtggtggtttgctgcacctattaacctatcttctaagttccctccactcatctcctacaccccaacaagcccagatgtgtgatgttcccctccctgagtccatctgttctcattgttcaactcccacttactagtgagaacaagctgtgtttggttttctgttcctgtgttggtttgctgagcttgatggcttccagcttcgtccatgtccctgcaaaggacatgatctcatccctttttatggctgtgtagtatttcatggtgtatttgtaccaaattttctttattcagtctattattgatgagtatttgtgttggttctatgactttgctattgtaaatagtgctgcaataaaaatgcaggtgcatgcgtctttatagtataatgatttatatttctttgagtatatacccagtaatgggattgctgggtcaaatggtatttctggttctggatcctttaggaataatcagactgttttctacaatggttgaactaacttacattcccaccaacagtgtaaaacatttgtatttcttcacggcctctccaacagctattgtttcttgaatttttaataaaccaccattctgactggcgtgagatggtatctcattgtgattttaacttgcatttctctaatgatcagttatgttgagctttttttcatatgtttgttggctgcataaatgtctttttttgagaagcgtctgttcatatactttgcccactttgtgatggggttgttttttcttgtaaatatgttcaagttccttgtaaattatggatattagacctttggcagatggtagattgcaaagattttctctcattctgtaggttgcctgttctctctgatgatagtttcttttgctgtgcagaagctctttagtttaattagatctaatttgtcaattttggcttttattgcaattgtttttggcattttcattatgaagtctttgcccatgtctatgtcctgaatggtattgcctgggttttcttttaggtttttatggttttgggttttaaatttaagcctttaatccatcttgagttaatttttgtgtacagtgtaaggaaaaggaacagtttcagttttctgaatatggctagccagttttcccagcactatttattgaatgggagattctttccccattgcttgcttttttcaggtttgtcaaagatcagatggttgtagatgtgtgttgttatttctgagggctctgttctgttccattgctctatatgtctgttttagtaccagaaccatgctattttggttactgtagccttgtagtttggtttgaagtcaggtagtgtgatgcctccagcttttttctttttgcttaggattgtcttggctatatgggatcttctttgattccatataaaatttaaagtggttttttctttccaattctttgaagaatatcaatggtagtatgatggaaatagcactgaatctataaattactttgggcagtatggtcattttcatgatactgattcttcttatccatgaggatggaacgtttttccatttgtttgtgtcctctcttatttccttgagcagtggtttgtagttttccttgaagaggtccttcacatcgcttgttagctgtattcctaggtattttgttatctttgtagcagttgtgaacatgagttcattcatgatttggctctctgcttgtctattggtgtatagaaacgcttgtgatttttggacattcattttgtatcctgaggctttgctgaagttgcaaataaatttctttttatttctaccagaaagagggtttattagaaagagtatgctactatattatgtaactcagtgtgcaatgatgactaaaactgagttgaagaaacagtgtttttgtctacctaaaagagtggcatcaatctgatagagaaatgactttctattggatacagaccaagcaggaggcttttctttttggacttaaaaactgggtaggccacgaaataggtatcaataaatttctcaattttccaacacagccccactgcacttagaattataattattggaatgttttccaaattctgaaaggatattttattagaattttagattttaattatgttgtgagttgtatcttttacatttttcttcatatttttgttgaaaaggtgatggagcctccaccaacatagtgttttagttttcagttcagaaatatatgtggtgctctagtacaaggctgaggttccaaacttctattacaacctgaatgatggctagaagttaaaagtaagagtatgtgcaaagtatacattaggataagataaaatacgtataaagacaaaagatattttaagtgaaaaatgttgtcttctaattagtacctcttgctgtattttgtgtattttgtatatctcttaaaataactctatgaaaaaggataagcaaataaaataaaattatatatataaatcgcatgtattaaatgaaagcaaaaaataatacatttttattttattggaattttgacatatatttgtatataaaatgttaaatagtggtttgtaggtcagattatactttatctataaaatgtaaaaatgtaaagtacttaaaagtaaactataaaaataaaacaagatgatactattgctgatatacgcaatattttgttttcttatggattaaacatggttttatatactcctctcaggacttaaacacttttagcatgtttttagaaaaaaaaaaatactagcgatgggcatggtagcttacgtctgtaatcctagcacttttggaggctgaggtgggcgaatcacctgaggtcaggagttcgagaccagactggccaacatggcgaaaccctgtctctactaaaaatacaaaaattagctgtgcatgggggtgggcacctgtaatcccagctactcaggaggctgagtcaggagaatcccttgaacccaggaggcagaggttgcagtgagctgatatcgttccattgcactcctgcctgggtgacagagtggagaccctgtctcaaaaataaataaataaataaataacacaaagaaaaaagatactcttttttttaattttctttttttttctttttttaaaatctaccagtaaagcatgtgagaagcacatttccctgtgacagactcactggtataaagaaataagaaatacaaatgtctttggtgttgtcatgatgattccaagatggtgaggaaaggctttcttttcttagtaatttttgtttgtttgtttgtttgtttgtttgtttttgagacggagtctcactctgtcgcccagactggaatgcagtggtgcgatcttggctcactgcaacctctgacttccgggttcaagtattctcctgcctcagcctccctagtagctgggattacacgcatatgccaccatgcctagctaatttttgtattttttgtagagacggggtttcaccatgttggccaggctggtctcgaactgctgacctcgtgacccatctgcctcagtctcccaaattgctgggattaacagttgtgagccaccatgcccagccttttcttagtagtttttaacctaggaaggtacactcactaagttcattgtgtgtttttcagaaacctctatatatgttgtattaagtttattactttgctttgtgtacttgattttgtatcttgtaactctactgcatttgtttattcattttaacaatttcttgttggagtcattagggttttctgtatataagatcatgtcattggcaaacagggacaattttactttcccctttccagtgtgaatgtcttttatttatttctctttactgattctctgggtagtatttttagtactatcttgaataaagtgatgagagtggatatctgtgctttgttcctgatcttggaagcagagctttcagtttttcatcttcaatatgatgatagctgtgggctttttacatatgacctttattaagttgaggtaattttcttctattcctagtttattgagaatttttatcatgaaaaggtgttgaattttgtcaaatgctttttctgcatctgttgagatgattatatgattcttatttttcattctgttaatgtagtataccaaattagcatatataagaatacaacgggatgcctattggtcaggatcacatcttaagtggttatctgtgtctagatatgaagcctaaatattgagcctaaatcactctgcagaggcccacatctgcctgatggcatccacccgcaagggtggccaaatactaaaagggtaattgctgcctcatagactctccttactacctatgtaacattgctaaaagtcctatgcagtacatagtgctacctttttctgttacaggatgaggagaatatgaggcagggaagtttacgactaaccctggtgtctatgggactagatccctttcagtgaaatccagcatctactcctctaacctctacactgcattttctgtattagcgtgatatgaaacttctcaagggctttctcctctttgtaattctctatcagggaaagcaaatatatattttacaaggaggttattttcaattcatattctagtctactttagagaataacgaacttttattgaaactttccacatatcaattgattgtttaaggcttgacaaaaccttacagaattcatagagatacattatctttgtggtgagaaagggagttatttaaacaaatattgttaagttcaaatacgagtcctaacattttgtacctagagaatttcaggtttagaacataaaatctgaatgaagttttacttcatcttatttttttggactttttaaaaaataacagttaaaatagtgcttttaaaaactggaagattttttagttcctttttctttcctcagtaattaaaaaatatgatgccagtctagaagtctaatatcctggaatctcttgataattagaccacagatggaagggaatatcttttgctagatgtcttatttaacaaaaagattttattccactattcttggtttttacagcatctgtttcttcagaatgagtaataagcttcttgggattatttctgcatgttgaaatgaaattaattggagtcagaaaattttaaatgaaatatatttgacagacaaatttactaataattactttctttgagtcacacacacctgatttattagtgtcctatttgtatgcagacaactttagagtgccactgataattactctaaatctttttacattgatcctcatgaagttccctaaagaatgataataagttggaggttaaataagagaaatgtcttatttaccacctcctattatttctttctgatcttctcagtgtatgactgttaggtacaaaactttatgctaggcaaacaaacaaaaatcatgtttgctaattagttacgtgtattcaaaagtaggttaaccacaaggaaaaatgtgatagatgcaaataatgtttaaaacattgcaagaatttaaaatgaaaatgatagaagttcacaattcaaggaagttattgcatgtgaagcatgacttgaataaaaatatgatttgtaccaatggaatccacttaattaaaagaaagtatttattgatgtcaggcctttatctaggacttgggtgaacatcctaaacaagtcacagtctttatctaaagaaatggtcaactgaccgaaagacatggagacagaaacagaaaaatatgatcgaatgtattagtttctggtttagagatgtatgtggagccctaaacaaagctaagttactaagtctagaacctgaaggatgaaagttaaaggtaagagtgaatgcaaagggtataccacaaaaaaatatgtaagaaagccaacatgtttatgagaacataatatattcagctaactgaaataaggtttatactatttcaagacattgagtgcaagacttcattgtgaagagatgaggatggtgggtaaagtataaataattatgcaaaaatgccaagaagtgtgcacattattctcagaatacttgattttgacaaatgaaagatgtcatgattcaataggtaatttagcaaaatcgcccactgaagagtccaaaatagaaaaacagagaggaaaacaaagtttgtttcagtaaacaataatctttcaggttagtaaagatagagatcaggaattagattggccttagacttctcaacagaaatactagaagataaaagaaaatagaagaatttcatcaacattctaagggaaaattattttcaacccattatgatatattcagctaaatttcaattatgtatgttaggtaagaactttttttccaaaagtgggatgcctcaaaaatctacccttcatatatcagaaagttaccacaagatgtgttccaaagatgataaattaaacagggaggaaggaatgatggaagaaaggaaaaaaagggagggaagaagggaaaacttggaagggagggaagaagaaagacataggaactaggaaagggaaacttgacaaaggagagaaataatgaagttcccactcttaagagccaagaaaatgtccccaaataggaaaggggcagcccatacaattagagtaagaaggtaaagggtttctcaagatatttatataggaaaaaaggaatgcatccattacttcatgtacctgaccatattaggagaaaccttttatattctcatattcattcattattgatgggtagctacgtaactcaaaggaaaataattctttctactaaaaagacacctgcactgatatgttcatttcagcaccattcacaatatcaaagatatggaatcaacccaggtgcccaatggcagtggattcaataaaggaaatgtggtgcatatacaccattgaataccatgcagctataaaaaataatacgattatgtcctcagcagaaacatggatgcatctggtggccattaccttaagtgaattcatgcaaaaacagagagccaaatactacatgttatcacttataagtgggagctaaacattgggtataccaggcacaaagacaggatcaatagacactgtaaactccaaaagagggtagggaaggagggggaaaaagttgaaaaactacccattgggtactatgtttgctactcgggtgatggaatctttagaagcccaaacctcagcagcaacctgcagtatagccatgtaacaaacgtgcacatgtatcccctgaatttaaaaaaatatgaggtaattagtaacttcagaaaaaaatgatgggcaagaaggaaattttaattatcttatccaatataggtctgcattgaacattacttattagtaaaataatgttaatactgaataataattttatggtaaatttttacctaacattacaaggagaacaaaggtaccatatgttttgggggaaaagggacactaatataagagagatatatgtttctcttttgtatttggaagatactagatattgtctaatattagaaaatcaagtaatatttattatgtggcattaagaagtaaataggagaagtaagtagagaaggaaaagtggttgactagagatggttgaatttgttggtggaaagtgtggggtaaggcattgattatttttaaatcttaggctacaatagtaaaaagcaattaaaggtgaaggacttacagacataaatgataacttccattctaaaagtttatcagcaaagcagtagaaatgaagaaaaagagtgtgaaatagcctcagatcctaaaaattattattttttaaagatttgaatatctgagcatatatggaaatagagggaaaggaaacaacagagttgaaactgttaagacagaagaaaaaaatccagctaattgattgaacaagtgccctggaaggcagaaaagactagaacatgcttatgcatcattgtaataacagctctctttggcttctgttgactattgtttaataatagtacagaaaaatctgccaccttcctttttttttccaatctacttatgtctgtgaattaataactttaagcatgacatcaatttcagtgcagtgctagatttatatctagcaaaagaaaagttactggttgaagtgacaacagttatgagaaccagtatcagcatttgatgtatgtaaaaagacttaggaagacatatctaaatgcagtgtgcagggtgaatatgaaagagaaaaatagttcaaagaatttattctgactcctggggagaaggctctcactgaaatcattgaggaggcgagacttggagaaactaagggaagcagataatgcctgcatattattggagaaagataaaagattgtaggagaaaaaggaacttttccaaaagaaagtttatgctgtatttttctcctacattcgtgaatctttagtgttcctgaaaggcttcatattttggttataaaagaaggagttcccaagaggatctgcttttcagttttcctgtggaagctcttgattttgtgaaactcagaaagatagaatgttttgcatatcctcttctttatcaacctccctgacgaaaaccacctcttaccctctctttcctcaggggtactaaccaggctactccttgcctgtctggtgctttctttcttttaaactgaaactgagctaccccaacaccattctcagaaaacaaaccaaaaggaaaaaaaaagaggaaaaaaaacaataaaaaataaacaaacttaaatggatgtcaaaataaacctcacttatcttctttaggaacttcaccgctaattaatctattagctactttttcaaatcccactatttggatatctggacaaaaaatttattacttcctgttacctatgtatttaatcagaaataaagaaatatagttttgtttgttttttcccgccagaagatttctattgagtaaactagaacagattcatcctacttatgtatttctttgggtgttggtaattgagttgccaaatacaggtttgtggacatggacaggtctggttttcttggacttttcatttattaaatgtggcctcagggatatcatttattttctataaggatatattattacctgtccatagaagtattttgaagactgtgttttccctgatgtctcatgtggagtttgtcttattaatttatatttatttgtttttttctgcacctaacacgacttcatatctattaggtaattcaacacatggctcctaccttgagccgactgatcatgactgtgatgtgcagagcatgatatctggcataagttcaaggttccatgagaaatatgccttcctctccctccagaatcatcatctacgaaaagtctactggccagtttattcaattttttctcttttaaaaatatatattatcccagccgggcatggtggctcacacctgtaatcccagcactttgggaggctgaggcaggcagatcaccaggtcaggagatcaagaccatcctggccaacatggtgaaaccccatctctactaaaaatataaatattagctgggcatcgtggcgcaagcctgtaatcccagctgctcaggaggctgaggcaggagaaaagcttgaaacagggagccggatgcagtgagcctagatcatgccactgcactccagcctggagacagagtgagaatccatctcaaaaaatatatatattttatttttatatatatataatatatatatatataatcccttttggcctggcctgacaaatttcttagatgtatattatttctgttatgaagtaaaatagatttcaaagtgttgtcttacattttttcaaaaagatatgactccatttgtaagctggagactctcaattataaataagcagagagatgttcttttctcttgacgttttatattatacacatataagaaaatctttgaagagagatttaaagttatattttcaaacatctataaaagaaaaccaatctttcttccaaagtccaagctcatgccaaggcaaaagaggtggacaacaagaatgatggagaaggtttgtgcaaacttggaaaatctcatcttgtattcctgcagtataatatgctaagctagaaacaaacaatggcaaaaggtcatggaagagactgtggcatatttgtgaagttaaaatagtgtggtctgagaaggggaataagaaacagatcatgaaaatgaggaatatggatagagtttgttactaaaattcttgaatacttgctctgtgccaggcactatgctggtttacacaaaacaggcaatccttgcttcagtgaggtcacatctagtaaggggagagaggaataaggacaatgccttatgataaatgcctttgtaaaacatacaaaaagaactatatgagaaaatccttagtctcaaagaataagagtcccactaagtgacaagaacaaacagaatccctgaagaagaaataacccttgcagaagataagcaagaaatacaagcagtgtttggatgacaagtgaaatagtttggatatttgtccacatccagatctcatgttgaattgtaatctccaatgcaggtggtagggcctggtgggaggttgtttgggtcatgggggtggatccctcatagcttggtgctgtccttgcaatagtgagtgagtactcatgagatctgaatgtgtaaatgtgtgtggcacctctccccatcttgtccttgttcccaccatgggatgtgcctgctccccctttgccttccatcatgatttcaagcttcctgaggcctccccagaaacagatgctagcactatgcttcctgtacagcctgcagatctgtgagccaattaagcttcttttcttataaattacccagtctcaggtatttctttatagcaatgcaagaagagcctaacacagaaaacaagtgactccatatgccatggaaagtatttagaattctaacttactgaaaatggaatcatagatcaatttattatcttccttttagaaataacactttgaaagaaatgcaggccgggcgtggtggctcacacctgtaatcccagcactttgggaggccaaggcaggtggatcatttgaggtcaggagtttgagaccagcctggccaacatggtgaaaccccatctctagtaaacatacaaaaattagccgaacatggtggtgtctgcctgcagtcccagctacttgggaggctgaggcaggagaattgctgaactcaggaagaggaggttgcagtgagctgagattgcaccactgcactccagcctgggtgacagagagagactctgtctcaaaaacaaaaaaacaaaaaaacaaaaaaaacgtattcaatgtattgatttgtgggaggtaagactagagccatggatatatattacacacctttattattagttaatttcctttcatcaaaaatttatttagtgcttgcaatgtgtcaggaactaggttaggttaagaagataatttttacaaaggactttgataaaacaagtaaatcacaagattaccagatatttgaatgtataattaataatacagtgctgtcatttgtatacagggtttataggaggaggatcagatttttaaagatgtgagattgtctagttaggataatggtcccggggagatccagaactgagcatctcaaatcttaggttaattctgagaaagaggagtctggtcctgtctaagcaagacaggatatataggtaaagaatacaaccaagaaattcagccagaaaaaagaaatatatatatatatatatatatatatatatatttctttatatatatatttctttatatatatatatttgtgtgtgtgtctgtgtatatatatacacatatatacatacatatatatacacatatatatacatacatatatatccacatatatatacatacatatatatacacatatatatacatacatatatatatacacatacatatatatatatacacacatacatatatatatatatatatatatatatatatatatacacacacacacagacacacacacaaatatatatagcgccggttttcagtctgagatcagccctaatcgatccagatagagctgagtgtaataaatagaagtgaagtcttactatacaataagagaagcatctcaacactcaatctaggtaggacaagagaccattcaaagatcagagcagagaggtaatgaagaccgagcatctcagaatccagctgccacaagatcatttcagaagatcacagatagcaactctctttttgagcatctgtactagtttagtctcccattgctataatgaaatacccaaaactaggtaatttataaagaaaaaaacatttaattagctcatggtgctttcagactatacaggaagcatggcagcatctgctccacttttgggaaggcatcaggaaacttacaatcatggaagaaggcaaaagggaagagaggtgtctcccatgatgggggcagagggagagcaagagtgggaggtgccatccacttgtaaactaccagatctcatgagaacttactcactatcatgaccaaaggggatgatgctaaaccattgataaaaaactgcccccatgacccagtcatctctaaccaggacccacttgcaacaggggattacaactgaacaggagctgtaatccaaagggaattacaactgaacagggaacacagatctaaaatatcagtatcctctcttgaggaggcgattgagaactgacttgtgtgccgttgcttggggggtgtgtgtgtgtgtgcacgtacatggggatacatgtgtaagatgacaattagagcacaaatacctgagccagctaacatgtgcatgttgttcttctactgtgtgtccacagtgggataatgctcagaagagaggggaaaacatctggcaaggacattcctttgatgtgcacaataagccttggtcccagctgtcaacttttccattaatctctgtcttcagttcgacgctggaattcctgggcatgaccatctgtctgaatttccattgtgtggagaaattgaaaaaaaaaaaaaaaaaaaaacgttgagtccggaagacctttttgtatgaccttctttggtaaaaatattgaaggattttaaattgtgtgggaatgaggtagccatagataaaaattacatctgtgaccactgagtatttattgggtgatattcattttctctctccttttgcccccactccctgtctttctgcctgcctaacttattcactggcctcctcctttctttccttttcacaagaaatatgtttctcctctgagctatcacgatattaagaatatcaggctaaatatgcccctaacttcaggaagttctcagactcatgaaaaaaatggctatgtaaacaatgtggaagaatcaaagaaaagaaaagacatatcacatgataattatcagtgacataaaggattttcctaaagaaataagagagcacatcactgaaaattctttagtagtgtttctcacactaaggaaagagagaaaaatatcttagccagtgggtagcatgaaacagaagtgtgaaaatatgcttttaaaatgaatttgctagtttatggtgttagaacatagaatgttgggttatgatttgagaggatgttataggttattctccagattgtgactgacctccatttaccatgcaaggtagctgatatttcataataaggagcttgcagactacttttacagtgggataacatgatctaattctgactatataattttgtttcattttgtttctgaacactggtatttagatttgatggaacctccaaacagcatgcccagggatttacaagatgataaaaggtggaggatatctggataagtattttttaaggaaaatggccaagaatagaactggcacaagatgtgagaaggaaaagtttgaatatctaggtagattacttacttaatttgcatgttatttcaggaattcttaactcactgtctaccaagttccaggaattaaacaggatactggagatgaagtgctgtataagaaacaatactatccaattaaccaagccaacatgaaagccttgataaaatataatttataagttataaattatataattatatacacaaccagtaaagtccgtttcaagtgcatgaatgcttctggtgctttcactcacataattttgatctcatctaattttcgcaaaaattgaaggggatggtttttaagcatctcacttcaagcatattccacgtgtaatttcaccttttcttctgaggcatcttgtacggtgcagaaacatgcacgagtctcatcagacatgcgagtgcagaccggaattatgaagatgtaaataatcccagagacaaccatccacaaataatggtaactctttcctaggcaattatttgaggcattttatcaactgctcagaaactcccaagcaggcttatttgccctcagctgtgtccttaatggcacacccaagtcccttagtggtgcttcatgttaatatctgcataaaaaatctgtgttacatactttattttcagatggaccttgttcctgtagtgcacatacaattggtaagtgtaatggcctgagaaaaggtatccttatgagatgttgaaactggattactcattggatagcagtaagtggagtgtgggtatgtatatttcccatacaccagttcaaacagtgctaaaaaagccagagggtttgtaaattagttcaactattgtggaagacagtgtggtgattcctcaaggatctagaatcagaaataccatttgacccagcagtcccattactaggtatatacccaaaggaatataaatcgttctactataaagacacatgcacatgtatgtttattgcagctctatttacaatagcaaagacatggaatcaattcaaatgcccatcagtgatagactggataaagaaaatgtggtacatgtacaccatggaatactatgcagccataaaaagaaatgagataatgtcctttgcaaggacacggatgaagctggaagccttcattctcagcaaaccaacacaggaacagaaaaccaaacaccgcatgttctcactcataagtgggagttgaacagtgagaagacatggacagagagtgggaaacaacatacaccagggcctgtaggggggtggggtgtgaggggagggcacttagaggacgggtcaataggtgcagcaaaccaccatggcacacgtatacctatgtaacaaacctgcacgctctccacatatatccttctctttttttatggaagaaagaaagatagaaaaaaaaaaagccataaggcctccaaagcagtgtttaaatagttccttattattttcattggtagcacaaaccatgttgaataacaggcccaggatttaatttttagactgcaaagaattctgaatgattagcctggagaagtatcatttgccaatatgaggatgttgataggagtatgttgggagcttgagacatttgagggatattttgttaaacaagtctaggaattttgaacttcagatcctctgaattctctgggctgagacagaactcccctctccttgctgtaggagagacggttcctttcttcacaagatcctgaaaacgtcttagctgaggcagatagttcattggccaaagcttatctttctcaagatccattcctgaccccacaatataatcactagggtcacatctcagcataacgcagcagggaaatgcagtccttttgttgggggaaagatgacaacaacaacaacaacacaggctgaaagagttaaaggtcctggcaatatatgctggtagaaaacttatgggagtggaacttgaggacattgaaccagggttaaaggtaaaatataaggcttaataagagatatttgttgatgtaggattagtgcctcatgatttgaggtttaatatcttagcatcttaagtcattctcaatttgttgttaaaaggttctttgaaacatgaacttgccaaagacccacagtgaacgagatactggtactatctgaggaaggcgtcaaaaggacgatgaatttgggaattttataatggaattgctttgtgagactggaaaacccaccacttcaacatattccatgaaaagactcaggtgacttttgcttcactaaggccataagaaatacattggtaagggagttactggcatctgtaaggcagtcagtgatagatgactgctgcagtccaggctaacagtaggacatgctgttatgaaactgtttatatatacatatattaaagggatgaataagattctggagtggcagaggctacaaggtgacacttaattgttagaagaaagatagtaaagaataatttatgtggtgcatatcagccaaactgtctcctttgccaagggtggagactatatatgtgtccaagaacacaggctccattgcatctataaactggctgaatgcccagttttctaatagtaaagttaattggtgagctctcaatgtggaaccatcttttgtgaaaataagctatcagtttgtggaagttgattacacaaacattttcacaatggagggtgaaaggcattaattcattcttactggaattggcacttacgatggatatggttttactcccttagcccatagtttcagagggctaacagacatgggatcttataaccttgcctcagcccacatgacctctttaaaggcaaggaggtgagataatgggcatcacagggtccactaatcctacctcctactctatcatctggtagtggctgctataatataataatgtgttggtttattaaaggatcattcaatggctagctcagttttaaagttctgtgttcaggacattgtcctatttggggggcaatatatgcactgaaccatagccatgtatccaaaagctaaaatgctatagtgtaaatcaagtagaggaagtagtattaaccatctcatcatcatctctagggacgcaattgaaattttttcctcctgtctttgcaacccttggttctgctggattggaagttcttgttcttccaccaagtgatttattacgatttctatttaacttgaatgacaaatactgccctttcactttttctctctatgccactagaaaagatgacaaagaaaggagttactatatggcaatggccattggtactgattatcatgaaggggtgaagctgcttctatattataggaagaagtaacagtattccttgaacttgagaaatttatctgagtgtgtcctggtgcttttatacttagtagtatattagtatacttaatacttagtatactaataatattaataagtgtaagtattatagaagtattaatacttacacttattagtatattagtatacttaatagtaacaatggagaaaagtctgttgcagcaaccatgccttacagggcctcagtaacctcaaatgtgaagttctgggtcactcccaccaagcaagcaccaagatcagctgaagtactaactgagggtgaggaaaatctagaatgagtggtggaaggtgaggatgatgaatatcaaagataaccttgggaccaggagcagcagaattatctcactaaccttccaatactaaatgttttataaagacggtggcctgtctcttccctgcactttggttttgtacctgtgtgcttgagttaacgccactaagcgcacatctcaaccagaaagaagtagatccagtggatagatgcttctcaaggtcaatcctgattctgataagcattgtctttcctcagactctcctgagcaagaaggaactctagttgctttcagtgtagacttcagtaatagcacttcgagtagcatttttttcttcttttattgtctttcttcatttattttcaggttctgctttcagatgaattccttaaaattgtctgttataaaaagcagtatttatattgaacccaaaaatgctgcaaaggctacagacaatgccgaaaggtgggaattttatgaggaatatcaaggtagcagtgtctgtaattgtcagttgttttggttaccagggccagactgctcccatgggcttatctgtaaatacctttcaattcagaatatttatatttccagttccttctttttctcaattgtatatcttcaatagtttttcctaccaaaaagaaatattcggcacaaactatctgactttcatttgcaagccattttatgactttgtgttatataaataacaagatttttcattagacgaatggaactagaaaaagtgccttgtcaaaactgcaacttttgacagttagcctttccccactatgaattaattacatgaaacaacttcacaaaaattttttcagatgtgattatttctttagaactttctaagagatgtgagaatcaaaaatgtattcagattcagatacatatttcctcgtatttggcctccttcataagcttctaccatttaatagtgatggcaaattaaagtataatttagtaaaattcatggtgcaaatatgagagcaactgagcaactcttaaattagttgggctatatttgttttcttactttttcttcccttagaatacttcagagataacataaaaaaggggaagttgacatgttcacacattttctgttgttgaataaaataatggtattacagatcatcagaatttttttcattcgggtgattcttatggtgatacttggtaatatctgagagctgaattatataacacagtgaattccatggaaaatgtgttgagttgtaacacagactgtaagtggaccatatttagcaggcaggacaatcatcacagtcacattattttcatattgcacatattccatcatgctttgaaagcaacatttaaaatgcagagcagaaatgtgacataatatttatgtcttcataaatattaagccttcatacaattcagtcattatatttttagtcatattaaaagggacataactatattctataataaaaattattacttcaagtataacttacagcagtcaaatctacatcatttgttgagtcaaaactctatcaatttaagtagaataaaaatctaagaaagcacaaaattatatatggatttgattgggtgtgagaatattaaggtttacctagatgttgtttcataatcttttgtttcctcacatttctgtataaagcagttttgttaataatcagttttaatgtgtaacaagaatatttaggtggaaaattaagatattattctatgttgcactgtgttacattggaaactattaaaatcacaatatagtttaaaatacaaaaagaaaaatttattccctaaccaaatctttggagacataatcagtgtaacattttagattgcatttgaaatatgttcagaacatcaaatatcactgtggagagttttattccaacattagagaacaggcaagtttcaaatttgtatctcctaccctgattttttcaagaactccagatgagtttatttgactgcatgtttgtcatctctgatttgctgtacaacaggcatctcaaaattaacatggccaacactgcacttaattatcccctgacctaccagtcccacagtctcccccaagttaccactaaccagtctctcaaatttaaaactatataatttaaagtagtttttttctaattctgtgaagaaagtcaatggtagtttgatgggaatagcattgaatctatacattactttgggcaatatggccattttcatgatattaattcttcctatctatgagcatggaacattttccatttgtttgtgtcctctcttatttccttgagcagtggtttgtagttctccttgaaaaggtccttcacgtctcttgtaagctgtattcctaggtattttattctctttgcagcaattgtgaatgggagttcattcatgatttgactctctgcttatctattgttggtgtatatgaatgcttgtgattttatcctgagactttgctgaagttgcttatcagcttaaggactttttgggaggagacaatgggattttctagatacaggatcctgtcatctgcaaacagaaacagtttgacttcctctgttcctatttgaatacccttaaatttcatatggaaccaaaaaagagcccatacagccaatacaatcctaagcaaaaagaacaaagctggaggcatcaccccaacggagttaagctatattacaaggctacagtatcaaaaacagcatggtactggtaccaaaacagacatatagatcaatggaaaaagacagaaacctgagaaataacaccacacatctacaaccatctgatctttgacaaacgtgagaaaaacaagcaatggggaaaggattccctatttaataaatggtgttgggaaaactcgctagccatatgcagaaaactgaaactaaaccccttccttacactttataaaaaagaaaactcaaaatagattaaagacttaacatgtaaaacccaaaaccataaaaaccctagaagaaaaccttggcaaaagcattcaggacattggcatgggcaaagacttcgtgacaaaaataccaaaagcaattgcaacaaaagctaaaattgacaaatgagatctaattaaactaaagagcttctatacagcaaaagaaagtagcatcagagtgaacagccaacctacagaataggagacaatttttgcaatctacccatctgacaaaggtctcatttccagaatctacaaggaacttacacaaatttacaattaaaaaaacaaacaatcccatcgaaaagtgggcaaacaatatgaacagacacttctcaaaagtagacatttatgtggccaacagatacatgaaaaaagctcataattactgatccttagagaaatacaaatcaaaaccacaatgagataccatctcatgtcagtcagaatggtgattattaaaaagtcaggaaacaatagatgctggcaaggctgtggagaaataggaacactgttacactgttggtgggaatgtaaattagttcatccattgtggaagacagtgtggcaattccaaataccttttgacccagcaatcacattactgtgtatatacccaaaggaatataaatcattctactataaagacacatgcacgcatatgtttattgcagcactatttacaatagcaaagacatggaaccaacccaaatgaccatcaatgatagattggataaagaaaatgcagtacatattcaccaagaaatactctgcagccatagaaaagaatgagatcatgtccttctcagggacatggatgaagctggaatccatcatcctcaacaaacttacacaggaacagaaaactaaacactgcatgttctcactcataagctgattgcaggatggggagcaaggggagggagagcattaggatgaaaacctaatgcatgcgggacttaaaacctagatgatgggtggataggtgcagcaaaccaccatggcgtatgtatacctatgtaacaaacctgcacatttcacaaatgtatctcagaacttaaagtaataataataataaaaataaaattgaaatatataatttatctctgatttacatattctaaaaaagtatccaatacataatctatttgcaaatgctgcaaactcacaagtatatctgaaatcacctactcctccatgcccttataacaaggcaccctagctgatgtctctggcttgaactactgcaacagccttttaatcatttttctcttttcctttacttaatctgtttgaatctagaaaaagttgatccttttaaaaacataaaccacatcattacatactttttcttaaaattattcaatgtttttcatcaatattgaaattcaatggaaacttataactgcggcaaattaactccaatcgatctattcttagcatacctgatcaacttccttccctatatcatcatgcttcacatccaccagtgtatagagttactttccttttatttctttcaacttcctgttcattcccaactgatacttttccatctgtcgtttcttattcctagactattattacccctcatttctaatgtctagtttctcttgggtgcaattttcttttaacattcattgggtaacagtcagattcttgctaagcagacaagtcactttaaaacacttcatattattctttattaaataggtgtatcccaattttacactgtccattctagatagctagctaggcatcatctacctgtcattcatttgttaagcaagcaacctgagaaaggatcttagcttgtcttgtaaagcaatgtatctcagaacatagtaagtgtgtataagtatctgtaggttgatttcaggatgcatttccttctagctcttatcactactaaagtgctttgttattggaaaacaaagcacttctattaagtcccacaaagtggaaaatagtttattaagacgtatcaacttttttgtatttctaatatcccaggtgatgctcagtatattaagggacacaataacgtatgttttttaaggtaactacatttgaaaccaattaatctagtttaatgtaggtgatcaacacaccattaggaaatcattgcattcatatgtttatatacatgacaaatattataaaactagtgttttgagatgcaaaaggcaatattctcttataagattcatgagtccattaagctggtactaattaaaatacatatctatatccataaaagtcaaattcataatttatgtattcaagttaaaaattctaattcagaattcaaatgtatgtttatatagatttataaggcatttacctaatgctttttcataatttagaataaaacctgattctaggccaggagccgtggctcatgcctgtaatcccaacaccttggaaggccgaggagggcggatcacgaggtcaggaaatcgagaccaccctagctaatatggtgaaaccccgtctctactgaaaatacaaaaaattagccggatatggtggtgggccctgtagtcccagctactcgggaggcccaggcaggagaatgatgtgaacctaggaggcggagcttgcagtgagctgagatggcaccactgcactccagcctgggtgacacagcgagactccgtctcaaaaaaaaccaaaaaaacaaacacacacaaaaaaacctgattctaatattagacatgaccgtagacaatagaagactagattgcctatcaatagagcaaaggtatcactcgcctggtctctgccttcatcaggaagactgttaatattccttctctacattgcagaaactgagagttcagtatgttaggttatacatgaaattacctaaaaattcacaaaatgaattaattgttggaaagactagcttgaggattgaagaaaattaacatctattttataattttatataagatactgctatttatatatcttaagacatacattaagaatttctgttctgttccttatcacagatatctgtcctaaccatagcattttcccctcaaagttggaaagactagcttgaggattgaagaaaattaacatctattttataattttatataagatactgctatttacatatcttaagacatacattaagaatttctgttctgttccttatcacagatttctgtcctaaccatagcattttcccctcaaatttataactttgtttacatagagaatgggatgtgttaattcagaataaattctcccataactgaaaaaaattttaacaatgtgtaaaatacaaacgaggcaaggaataataagaaattaagactataacaggattataagacctcttacattttaatgtaatttttgaaattaaatttttctaggagtctttttacaagcaaatacttagtatgaagtttgaattccatagaatgttaatgctatttaatatctaaatcaacttgctaaataagtcacatgccatttaatcattatacaataatgaatgcttttcaagtaaaaagcttaaaacaccaaaataagaaaaagtgactttaaatttgaggaatatgaggaagctatgacaaaggaaccattcatgattgtttatacttaccatgttttgtttccttaaataattcaggatttctaatttctaatggaaggctttcaatcctatggcatcacagacatattgtacggattcctgtgactttgtaagaagcattatatagcattataaattaaatgacagtgaatatgctatcatattggtaataaaatctgtaaaaatggccgggcgtggtggatcacgcctgtaatcccagcactttgggaggccgaggctggcggatcacgaggtcaggagatccagaccatcctggctaacacggtgaaaccccgtctctactaaaatacaaaaaaattagccgagggtggcggctcgtgcctgtagtcccaactactcaggaggctgaggaagggggactctcttgaacccgggaggtggagcttgcagtgagccgagatcgcgccactgcactccagccgggcgacagagcaagactccgtctcaaaaaaataaataaataaataaaaataagatgtgtttatattttcttcctctgaatttttaataagcatataaatgggcaaagttccttctagtactgcctcatatgtgtttagttattttggacttctcttatatcatagattttaaacccctcaaggtcttaattttaagcattttcccctctttgttattgaattccatgtttagtaattgcaaatatattttgttcaatcattccaattaaagactcaacatataagaattttaaacaatgtaaatatattatcgttttcattagttactttgcctaggtactgatgaacacgcaaaaaaaaatcatgattacaactgtctcctaagtagctatcattctgatcttaattgatatgaaaaatgtaagcatcacacaaacctatttattatataacattattatttacatctttttaaattaaagttgaattagtatgtttataaagtgatatttagatttattttcatttaaataacaaaatatcatcaatctattatttaagttataatctgttaaaagcatttaaagtaaaataagacaactgaaatatataaattactaaagaaagaaaataagaaaaagaatacattaaaacttaaagaagaccaaaaaaaattcggatgacaatttattattttccacacattgtatattgatgctatactgtaggtttactgtaggaagggcatgtaaaattaaagatgtgaaatgacagttgatcaaatcttctgctgtaagacctaatctttcatcaatcctttcaacaaaaatgaaagctaatattaagaaatattgagagagtatccctgagaaataataatctaaagctgataccaaaatctgtcagccactaaactatgattaaatatattaggtcaagcactgttttattagccatattacaagggagatgacatattgaaaatctttaacaccagtttcgtgtcagtagtgaaaaatcttatggtaacctgaaatcaacctctcccttccaagagttatttatcacatagaatagattgaagttggtgaccagatgcccagtaaggtagattgattttgacagaatactgcctggataaaaagtgaggcagacaagaaagtggattggcacctagctagactggagcctggtttaagaaactgggaatttttagccacttagggagaatgaagtgtgaaatcctttgagggttgccataaaatatcgtgcagctacattagtgcacaaaggcagccagctagtggggtaagaaggagtctaaagtgctgaaatccctgaactcattctaggcacaagcccttagtacataacttccactgtaaatggggagtgtgtgtgtgtgtgtgtgtgtgtgtgtgtttctttagccaaatatccatggataaaaaataaaggctctgagagaagaacaattcctgctttaaatcccttttataatactggtccagggtgaattaacaaatgtaaatcatgttttttgttctattgtccactcacaattatatctattatggtcatcacttatcaaaaatgctaaagagaattatttgttgagtggttctcttttatgagtctagttcattttaaagtccagttctcaagtggtaaatgtatactgtaaactttgagcactttattttatcagaactcttccagattgcattttgataacattgtatctgatatgaataattaactattatgtatgtctatatttagtttttgatatttttgaataaacctctaaatacatagagaagtcagtgtagaagttctgtcaacattcctttgccaaataagtaaacatgaacctaaagttacagagactttagaagctatatactaaggatggtttgcctgattatgacaatcactgtgcaaaagctggtggttttgtatagcttcagttgttaacaatcatattgacctttttagtattctgatttacagcttcacataatctggaaatagaatttctcacagttttagagttgggaatgtccagtcaggttatttgcatgattgggtcctggtaaaggaaaactttctggcttgagcaaggctactttcttgctgtgtcctcacatagtggagggagagagaaagaacaagctctctagtgtctctttttataagggcacaaattccatcctgagtgccccagcctcatgacggcatctaaatgtagttacttctcaaaggcctccacctcctaacaccatcaccctgggtgttagggcttcaacatatgaatttgggttggaacacaattctgtccttatatatgtttacatttacatatatatgatttgttttaatgtagcctaccttcctctcttttctaaacatcgctaatttaaaactgaattcatctcttccagcatatggaacaagacatgaatatttttagaccgatttcttcaaagttttaggacagatgttttcagaactctgacttttaacaattttttggaaccttctgggacttaagtctgtgggagtgtagctttgggccaaacaatctgagctgcctttctcagtttatttctcaactgaagaaaaggaagatttagaaacttgctgtgtgtggttgcgtgtaaacgggtgtgtgttgtaattttcttttgcttcaaactcatttgaattatgtcattttgtttaaaatgacctttagattacttcaaaaccagaaccatttttcatgattgctagggtgattgtaggaactgagaaagaaaaatctgccccacactgattttccttggaataaagggtgttttaggttaaaggagaaattaagaaagcagtttctctgtgcaaggataggattaagttgacttccaagctgtagtcctctgttaactgtttccagaaatgtcatttaaaaatttagtcatatagataaagtcacttctcatgaattatgtctcttatacctaggcgtttgtttttcttctttaagtagtttatactttgttcctaatttagttcaaaaatgaaaagtaacttaaaaggctcatcagagcacgttgtaagaatgttcttcatggattatctgaaatgtgagtgatgaactgctataatacactgttatggcttcataagcttaatcagaatcccctttaacctggaatatgttggctgcttgaatcctgcctctgctagaagttttctggacaggctatctctcagtgaagttagactcttttcttcacagtgtgggtgacatgtatatcagcagaattgttaaagctcaaagtaaggtgacagctgccaaacttgcgaagttgagatttcatctccattaccagtagatgaactgttccctgggtctcttattaaggtcagcctgactcagtagcctgtaacctccttgaagccagtctactttctctcttttttttttcctatctttttaattgctattgtctgttaaccagataagtgccataaactaattttggtctagggacagatatcagaattgaatcctatgtaatatgtctatatatcttaaaatttaaattttgttgcaaataatcatttcttttgattttctggagtatagtatctgggtcctttatagacaattgttaatacttcaaagacattaagtgaaatagcaagtgaatgtcttccaaatctattttatttccttttacaatacattataccaggtttgaccctatgtggaaataacagaatgtccacaggccagtggcattgaaaagaatctcttccacctcagattttcctttttgaagatctggaattaatgagaagggaagctcaggattttgaaagtcagaaagcaataaggtagaatagaatgggaaatagcagaatacatggaatttagaaaactgcttaatgcaggagtctattatgttaattttcattacgtaaatatgacattcaagtttcttttgatttccatttggtttccttttcttccatgtcagacaaggagaaggcattcagctccttagagaatgaagagatttataatcagagacaaagagagaggaattatttgaaaagactgaaagaacaaataaagaacatgttttatttagttttgtcacttaaattgaagtatttgctaattttgttgtacattaaaaaatctctagaaacagtatcatgtattctttttctcccagtcaccagtcgtctgaccacaataaatacttcaataaatcacgtacattaaaacttctttttaattactaagacttgcagttcctccttgttctgagtgacaagaactttttgtagtcttaggaaattttctacatgtttgctgaagcagttcttttagaacacattttttgaaagagaattgtaagtatgtagaaaggaagggattatacttttcatgtagagaagcaagatgaatttagtagtaaagagaacatgttttagacaaaatcaaattcaaatctctcattaactcattatagtcttcaaaaggcaagttacataaaatacctgacacttaattttctggtacagaaaataaaaaaataaaattaccatgtagtactaagaactaaattagataattttaccaatattcaattttagccatcacagccaattattgtcatgattttatagttctctcaagcttcttattcattagaaatataacattttgtagatgtggcagacttactagttaatgcagggaaagaaggttaatatgaaaagagttatttaaattgatgaacttcttgcctgattttcactgaaaaaaatgttattttgagagaatcatatattttgtttttccaaaaaaattatgaaaataaatagaaaagcatgcactttaaatgtacttttaaatactttccatatctctgcactgctgaacccacatggattccttatatagctactataactgcccatcaggttctccttgcccactgcctagacagagcctatttatcaagagggggattgcaatagagaaatagtttaattcacacagagatgactgcatgggagaccagagttttatttttatttgaatcggtctcctcaaaaacttgaggatggggatttttaaggataattcggtggttagggtgtctgaatggggggagtgctgattggtccgggtggacatgaaattataaagagtagaagctgttctcttgcactgagtctgttcctgggtgagggccacaagaccagatgaaccagtttatctatctgaatggtgccagcttatccgttgagtacagcatctgcaaaacatctcaagcactgatcttagattttacaaaagtgatgttatcccgaggagcatattgaagaggctcagactcttgcagccttcagttttatgactcctaaaccataatttctgatcttgtggccaacttattagtcctgcaaagacagtctagtccccaggcaggaagagggtttgttttgggaaagggcggttattgtctttgtttcaaagttaaactataaactaagttcctccaaaagttagttcagcctaagcccaggaatgaacagacagcttggaggttagaagcaagatggagtcagttaggtcagttctttttcactgtcataattttctgttataatttttgcaaaggtggtttcactactcagctgaggtcaatacagatttgttatactagtcatattcaggaaacgttctctgagaataagtgtcagtatgttaattaaattttgagagtcccatctttttaagctgttcagaggtagtattacggtagcataagtaggttatttacaaattattaatgatgattacttattgcaaccagtaatgaaacacatgttgtcatgttttcattttcttaggtttcatttcagaaagtgtcaatttctgtatccagtctaagctaaaagttaatttattcaatagttttatatttagtaaatacatcctgaaattagtgaattgtgatttgggggggttattattttccactaattatttctcttcgagaaggcagagaagttctcagaaaaagttgaaaacacttaaattaaaattgaaatataacttagagagtaaaatttaataaactgcttatattaagaaaacctacagccaaaagaaatctcattagtctaaaattaaccagtgagtgttagaaagaaacttttaatgaaagaagaataaaattctgtcacattcgaaagatgttaccagagcaatgatgctaactaaatgttgagtagagtttgaggttacattttatttccccttttctctgaaagaaaccaatacttatgcaataatttttgtaagaaatgaaaaaagtaaatttgttttgcagaagaatttttcctttgccacttattgacttagagttttaatctatctttagattaatacaagcaataaaaaagttgtcaatatatgtaataacaatatcattaaaatttaaaaaaatgttaatagctcaaagaaattattgaacaacagaatcacttctataatagagaatataagaaaaaaaaatgttttttagaactgaaaaaattatttttcaattaaaattaatttattctaatttttaattttaaaaatgttttcttctgccttctttcttattcctctgtctggaatctgaaaatcccactgtgattggcttatgaagtccaagaaagtccaagaaatcaatgctaaaaaatgctcaaataaaagcccagtggttatttaaaatttgcaagataataaaacacaaatctctaagtaaagataatataagaaatatatatgtttatatatataattttaagacagctgttataaaaaatgcttcaaaaagcaattaaaagcacatttaaaacagagaaaaaagctatcaaaaaagaactataaattcccagcatagaaatggaatacacaaagaagaaccaaatgtaaattttagttttgaaaaaccaaacaatttaaataaaaaacccaatggatgggatccacagcagaatggagaagacaaagaaaagaaatagtgaactgaaagatatggcaatagaaattacacaatctgaacataagagaaaatatattgacaaaaattgcacagaccctgagagacatgtaagacagtcataaaaggtctgatattcacatcatcagtcttaaaagtggggcttaaaaagtgcttgaaaaaataatggcttaaaacctcccaaatttgataaaagatataaacctacagtcaagaagctaggtaaatcccaaataaatgaaacacccaaaaaatatacctccagactctagtgattttactggagaattataagggagaaatctcactaaatctaggcaacttttcctagaaaatctaagagaagggtatactttcctatttattttatgaagccagtattaccctgaaaccaaaaccagacaaagattgtaagaaaaaagaaaactctagaacaatatctccatgttgaaaatgtatacatcaaaaaaactagggtttatttcagggactcaaaacaagttcaatattcaaaaatcaataatgtaattcagcatattaaaaggataaaaaagaaaaatcacatgtcataccaatgcaaaaaaaacacatttgacaaaattcaatattactttatattaaaacctatcagaaaaactaggagtagaagagactttcctcaaattgataaagagcaaatgggattatattggtggctatataccaaaggcttaaacctctgaaattaggagtagggcaagaatgtccattctccctacttttattaaacaaagtgctgaaaaataatcatagcttctaccataaggaaataaaagacacgcatattagaaacaaaaagaaagaaacataaagaaagaaacaaagcagttcctatttgtggataacataacggtctacatagaaagtcctaaatgaaatgttttataaaagtcatccagaactactaagtgaattcaacatgctcacagtttacaagataagcaataaacaatagtacatatttctatatactagcaacaaacagtgtacactgaaattaagaatacaacactatttgcaatccttcaaaaacaaaatacttgaggtaatatctaacaaaaggtgcataggactcaaatctaaaaattacaaaaatttgatggacgaaatcaaaatacatcttggaaaacagagagagactccatatttatagattggaagactcaatatagtaaaacacccaaatctccccaagttaatataggtaatgcaattcctatgaaaattcctggaaggtttttttttataataaagacaagattgttataaaatgtaaaattttcatttgaaaagtgagaaaacagtctgcccaaatgccaggttattatatagttatagtagtcaaaactgtgggttgatagagggagaaataaatagatcaatggaacaggacacagaacccagaaataaattcacacatcatgtccaactgatttgtgacaagcaagtcaatggaagaaacaacaacaacaacagaaaacctcaagaaaaaactaaaaattaactgaaaatggaccacagacttatatgtaaaatctgaaactatcaaacttttagaaaaaaaaatgtaagaggaaatattcagaggctaaggcaaagagttcttaaacatgacactgaaatcatggtccatgcaagaaaaaaattgtgatagatttaacttcattaaaattaaaatttatatcgtatgaaagaccgacctcagtgaggatgaaaagacaagctacagactggtgggaactacttgcacaacacatattggacaaaatattagtaacctgaatacacaaaaaactaccaaaatgaaatttttaagaatcaaattagaaatgggcaaaacatagagacattctactcaagtggatatacagatgacaagtaagtacatacagaaatttaacattcttattcattaggaaaatgcaaactgaaaccacaatggaatatcacgatacacctatcagaatcactaaaaaaagtagttataataccaaatgcaagtaagaatgcagaaaatcctgatcactcatacattgctaatgaaaatgtaaagttgcaaacccactgtgaaaaactgtttggcatttttaaaaatgtaaacatacaactaccatacgtttcaggaattgcattcctgggcatcttccccgtagaaatgaagacatatgtctatgcaaaaacttgcacacaatgtttacgcagtttccatttgtaatagccaaaactgaagacaacccagattgtgtttcagtgggtgaatagttaaataaactgcaagatattcataccatgaaatattgcttagcaatgaaaaagaacaaattattgccttacacaaaagcctgcataaatctcagagagttatgttgactgaaaaatgccagtcacaacaggatacatatcatatgattccatttaaacaatgttattgaaatgactaaattataggagtatagcagggattagtgatgccaggggttcatcaggaatttagggcaggagggtagtgggcaaggatatatacataaaaacaggaacacttttggtaatggaaatgttctgcattttgattgtgccaaagtcaatatactggtgtcatattgtactgtagttttgccagatatcatcactggggaaaacttggttcatctctacacatcatttcctacagtaaacaacatgtaaacctacaattctctcaaactaaaaagtttacataaaaattacaattaaactcaggcatgaagtacatttaatgctcccttctaagacattgctgtgaatttctagttcctagctctattttgggatgtgctggactgactgaagtgagggaaagtgatcgcaactctaaggcaagttatctcagtgaggtcacagctgactaagctggtagatatttatagcagaaccatacttattgattgtccgtgtttctttcatgaattttaataactttgcctggctttgcttttagcacttcttcagtattaaaaagtgaatatcctgaatacaaattcttaaactttccattaatctttaagaagcaatgtgctctacttggaactcctgaaggtatctttgaaggtattatggcacaagaaaatagaaagtaacccatctgtaaccagatgtccttggttaacaagctacttctaacatgacttgggatttggaaatcaattctacttgataactgatgaaccctggaggaggaggtagtgaagctctagggtagtggagaaagtgacatttattacgtttgaacttccacttttggctcatcactgaatctaaagtttatatactttatctcagacaatatttgcaggaactgtatgtattgaatatgagaaatgaatatgtaggtaaactcatttaccaaataaaacctaatgctggaacaacagaaaacaaaaggctaatctattcatcaacataataatatgaagttttgttacaacacactgccatagtgatcaggccatttcctcttttccttaaacagctcaaaacatgcaatagatatcttagacattaacattttactaatgggctgtacttcaaaaatatgtaattttgttgttagacattttgaaagcattggcacacagagaaaaggttataattgtttagattggttttatgacttactgccaaaatgaaattaacctttaatattgctgaattttaataatgttacaaatcaagcagaggtgcttggagcagaagttaatggaaaagtagttcaaaaaaactcatccttttttataggtttcactttggcataaaatttgaaagatgtaaattttgttgtttctgttcatcccttcaatttttgtaatatttcacataaattaggaaattaatttataattgttcttttttttgcattgtgaattttattttctaaattttgttgaaaaatttttgcgtctatgttcatgagatatattggtctgtagtttttgtttattgtaatgtgtttatcagaatctgttattttactaatgctagccttatggaagaaatcaagaagatagccagaagcagtggttcaggcctgtaatcctagcactttgggaggctgaggtgggtggatcacttgaggtcagaagttcaagatcagcctggccaatatgctgaaaccctgtccctactaaaaacacaaaaattagctgggcgtggtggcgtgcacctgtaatctcagctactcgggaggctgaggcaggagaatcacttgaactcagaaggcggagggtacagtgagctgagatcgtgccactgcactatagcctgggcaacagagcaagaaaaaaaaaaaagtgtatcctctgtttctattctctggaatatatggaaggattgacatcatgtcttttataaatgggtggtaagtgttcacaagtggatccgtctgaaattactgcctcttttatgagaagttattaattatgtattcaatttagtgaataaatacaggtctgtttaggttatatatttctaaatttataagttttggtaaggtgtgtctttcaagaaattgatcagtttcatctagcttaacaatttgtgagcacaaaattatgcataacgttccttttttaatcccttaatgtccatgaaatcagtagtgatgacgcctcttacatttttattagtaatttgtgttctcactttttttttcttagtctagggccttatcaattttattgatctttacaaagaacagcttttgtttaattaattttctgtactgtcttcttgttttcaattacattgattgcttatctaatttttattctttctttccttctgcttgcttgaggttttaattgctcttttttctctaggtttctaaggtggaaatttagatatttttatctttattttatttatatatattaattatgtattttatttatatatatgatgtgtgtgtgtatatatataatgctatacattttcctctaagcagctttcaatgcattcaacaaattttgatgttatatatattttttcatttagttaacaatgtttcagttagtcttgtggcttctttgaatcatttgttacttagatacgagtagtttaattttttaaatatttgggatttacagctatcattgtgttattaattttaattattttgttgtctgggaatgcagtatgtgttattttcaatcttttaaaaaatttttattttattttaaaatacataaaatacatacatcccagaatacatgtacaagaagtgcaggtttgttacataggtaaatgtgtgccatggtagtttgctgcacctatcaacccatcacctacctgttaagccccacatgcattagttatttatcctgatgctttccctctccgcgccccgctgacagggctgtgtgtgttgttcccctccctgtgtccacgtgttctcattgttcagcttccacttatgagtgagaacatgcagtgtttggttttctgttcctgtgttagtttgctgaggataatggctaagaacactatgttaaactattttgatatccttggaagaaatacatgtaaataataactattgttcaaaatagaaattatttgccttgggaattttgactgttgaattatttgtatactgtcagcaagataatttgcgtatgattgggggaaattatctttgaaattcatgttgcaacatccaattattttttacgatcttaccctagaaaatgcactcttaaaacttaccttggataaagtactatatattatgtcaccggtctcatcaccccaaatcaaacccaggcataaatgagacattgcataattaatctttaacttctccaacacataatttctcttcagtttttctctatgacaaccattaaacaccttatgagttatatggaacttttatgatcacttatgctccaagtaagcaactgtatcaacacaatgatttaacctttaaggtagattcccatgaatcatagattttacccagcgccaaaatttattaataatccaaaagacacaaggaagaacaaagaaaaacattttatttcttttttcaagagattgaacctattacttccattcaaattatcacttccattatggtagcagatgcattgttacaatgtacagagaagcactgttctcaaaaaaagccatttccccattgataatcttcagttttatattttgttagctgcccaggaagaaaaggccaatgtgaccaccttccattctctatactgtacaatggattcctaaacacaatgtttttgttgtttttttaattttttttatatttttcaataagcagtgaaggcaggctgattctttctttttcctaaaaagcaattttaatgtagtgactctccattatattactgtagtaaaaatcatctgcctaattacaaacacttacttcttgaatgatattacatatatgttggatcactcatcaaaacagaaatgtgattatattcattaagaagaagaaaatccctttgttattcacattggatcatttttattattctgtctaaattcgctgacaatttttatctttctctctcagtgctattaagcctatccaatgaaattttttatttcagcatttacgagtatgtctaatattgaatataatgattcttttaattgccatatctatgctgattccaaacatattcaattattttgaccatattttcactgtcatttattataatagatgacataaattcttgtcttaaatatctgagtcatctgtgatcttgtttctattgactacctttaattttgagcaatggttctcatttttccctgttgtcacatttttaaacacctttttaattttgcttattggtaatgatccactataaaaccctggattgtgttaagtgtcttttaaaaaattttaactttaataattttaaataattaattaaaaatttaaaataaataatttaaaatttaaataatttaaatttaaaataataattttaaaaatatttaactttctcctagaagaaacttaagttatgaattggtcttttgaaacttgtggtgacttcattaagataagtctatttcagtttaacttagtccttaatgaatctctaaattctgggacacagtctttccctcctaagcatggttcccttgcaatttatttttacttaatgtttattgttcattttttatttcaatgggtatgtagggaaccaatgatgtttggttacatgaataaggtctttagtggtgatttctgagattttggtgcacccatcacccaaggagtatacaatgtacccaatgtgtagtctttgatccctcaccccccacaccaaccctttcgcccgagtcatataatttttatgcctttgcatcctcatagcttagctcccacttatgagtgagaacacacaatgtttggttttccattcctgagttacttcacttagaattatgctctccaattccatacaggtggctgtgaatgccattatttcattcctttttatggctgagtagcattccacagtgtgtatatatatatatacacaacaatttctttatccactggttgactgatgggcatttgggctggttccacatttttgcaattgcaaattatgctgctataaacatgtatgtgcaagtatcttttttggataattacttcttttcctcttggtagatacacagtagtgggattgctggatcaaattgtagttctacttttagttctttaaggaatctccacactgttttccatagtgattgtactagtttacattcccatcagcaatataaaagtgttcccttttcaccacatccacgccaacatctattattttttgattgtatgactatggccattcttgcaggagtaaggtggcattacattgtggttttgatttgcatttccctgattattagtgatgttgagcattttttcatatgtttgttagccatttgtatatcttcttttgagaattgtctattcatgtccttagcccactttctgatggaattgtctttttcttgctgatttgtttaagttccttatagattatggatattagtcctttgtcagatacacagattgtgaagattttctcctattctgtgagttttctgttttctctgctgattgtttcgtttgctgtgcagaaactttttagcttaattaaatcccatctctttattactgttttgttgcatttgattttgggttcttggtcatgaagtctttgcataagctaatatctagaagcgtttttccgatgttatcttccaaaattcttatggttttatgacttcgatttaagtctttgatccatcttgagttgatttttgtataaggtgagagatgaggatccagtttcattcttctacaggtggcttgccaattgtcccagcaccctttgttgaatagagtggcttttccccagtctttttttgtttgctttctcaaatatcagttggctataagtatttggcttcatttctgggttctctattattttccattcatctatatgcttatttttataccagtaccatgttgttttgttgactatggctttatagtaagtatagtttgaagtcaggtcatgtaatgcctccagatttgttctttttgcatagtattgctttggctatgggggctcattgttggttttatataaattttaggattgctttttttctggttctgtgaagaatgatggtggtattttgatgggaatggcactgaatttatagattgctttaggcagtatggtccttttcacaatattaattctacccatccaagtgcatgggatgtgtttttgtttgtctctgtcatctatgatttctttcagcagcattttgtagttgtccttgtaggggtctttcacttccttggttaaatatattcccaagttttttgtttttgttttagtttcttgcagctattgcaaaaggatttgagttcttgatttgattctcagcttggtcactgttggtgtatagcagagctactgatttgtgtacattaattgtgtatcctgaaactttgccgaattaatttattagccctaagagctttttggaggagtctttaggattttctaggtatacaatcatatcatcagcaaacaggaagagtttgacttcctctttaccaagttggatgccctttatttctttctcttgtctgattgctctggctagaacttccagtactatgttgaatagaagctgtgagagcgggcatccttttcttgtcccagttatcaggaggaatgctttcaacttttcctcattcagtataatgttggctgtgggtttgtcatgcatgacctttattaccttaagatatgtctcttctatgctgattttgctgagggttttaactataaagcaatgctggattttgtctaatgttcattctgttgcaattgagacgatcatgtggtttttgtttttaattatcttatgttgtgtatcacgtttaatgacttaaagatgttaaaccatttctgcatccctgatatgaaacccatttgatcatggtggattatcttcttgatatgttgttagattcagttagctagtattttgttgaggagttttgcatctatgttcatcagggatattggtctatagttttgttgttgttgttgttgttgttgttatgtcctttcctgcttttgttatttgggtgatactggctccatagaatggcttagggagaactacttctctatcttttggaaaaatgtcactaggatgggtttcaattcttctttgaatctctgatagaattcagctgtgactctgtctggtcctggactttttttttttttggtaactttttaattaccatttcaatctcactgcttgttttggtctgttcagagtttctatttgtccctggtttaatctaggaaagttgtatattttcaggaattcatccatttcctctaggttttctaatggatgttcataaagttgttcatagtagccttgaatgatcttttatatttctgtgatatcaattgtaatatcatccatttcttttctaattcagtttatttgtatcctctctcttctttcctttgttaatgttgctgatggtctatcaattttatttatcttttcaaataactagtttttgtttcattcgtcttttgtggtttgtttgtttcagcttcatttagttctgctctgatcttcattatttttattttatcttaatttattttatttttgctaggtttgggtttggtatgttcttgtttctctagttacttgattttcctcaatttttttcctcgattatttcctcaaatatgttttccaaacttttagatttctcttttttctcagttcaaaatttttttaaatttccattttgattttgttgttgacccaatggtcactcagaagcgggttatttaattttcatgtatttgcatagttttgagggttctttttggagttggttttcaattttattccacggtggtctaaaagagtacttgatataatttcattttcttagattagttgagacttgtttcgtggcctatcatatgatctgtcttggagaatgttccatgtgctgatgaacagaatgtataggattttctgtaaatatctgttaagtccatttgttctagggtacagtttaaatctgttatttctttgttggctttctgtcttgatgacctgcttagtgttagtggagtattgaagtctcccactgttattgtgttgctgtgctgtctatctcatttcttaggtctagtattaattgttttataaatttgggagctccagtgataggtgcataaatatttaggatggtgatattttcctgtggacaagtgcttttgtcatcatataatgtccctctttgtcttttttaactgctgttgccttaaagtttcttttgtctgatacaagaatagctattcctactcgtttttggtttctatttgcatggaacatctttttccacccctttaccttaagtttatgtgtgttcttatgtgttaggtgaggctcttgaagacagcacatacttcattggtgaattcttatccattctgccattctgtatcctttaagtggagcatttggatcatttacattcaatgttagtactgagatgagaggtactattctattcatctatttatcatgctattttttgccttaatatcttatttgtttgtttttcattgtgtttttgttgtataggtcctgtgagatttatgctttaaggggttctattttggtgtatttcaagaatttgtttcaatatttagagctccttttattagtttttctagtgctggcttgagagtggcaaattctctcagcatttgcttgtctgaaaaagactgtatcttcccttcaattcaacaaattgaattgtatttctatgcaaaacacagaattataaaaatgaacgttatttataatttcacaaaaaatcaataaatgaaaggaatcaatctaacaaaaagtcctataaaatttctgggctgtaaaaaaaactattgaaatatataatgattaaataaatggcggaatctaatattttatgttcatggattaaaaaacaatgttaaaaagataaaattattcctcaattctcaatttatggaattaatcaatcaaaattacagtatatacttgtaaaagttggctgattaattctaaaggtatataaacattttagatagcaaatgatagacacaatttaaaaaataacaaaccgtcaattaaatttaaaatatattgacttcttataaagctagaataattaagttattgtggtatttgtacaaaggggctaacgtaacctaaaggcaaatccagaagcagacctacatatatatgaatatctgatttacaatgtagttggcattacagaagtgtgggaggacaataatttcttttaaataaatcgatctgaataaattactatatgtaagggggaaatataaacatggctcctgtctcataccatacataaatattcttgatgtaatgccaatttaaatatgacagataaaaagataaaatttaaaaaatataatactgaaaagatcattatttggaagagaacattttttcattagtgcactttacattttttgagcactgtaagatttacagaaaaattgagcagaatgtacagttctcaaatatcccaacagcctactcagtttcctctattattaacgtcttgcattgatgtcctatatctgttgcaattgataagccaatattgatgcattataattaattcaattctatagtttacagtaaagttcactctttgtgttgtacattctatggattttgacacgtgtaatgacatttattcaccattatcatgttatacagaagtttcactgcccccccaaatcctttgtgctttacctattcatccctccctttctccccaaaacacctagcagtcactgatccttttgctgtcttcatagctttgccttttccagaatgttacatcatttgaattacaaattatgtagccttttcagactggcttctttcactgagcaatgtacacttaattttcctccttgtctttttatggcttgctagctcatttatttattttttttcatcgaatggtatttcattgtataaatgtaccacagtttgtttacctatttacccattgaaggaaatcttggtggtttccaagttttggcacttacaagtaaagctgccacaaatgtgtatatgtgtgtgtctatgtgagcataagcttacaactcatttgtacaaatattaagaagcatgattgttagattatatgataagaatatgattagtattttaagaaatggccaaactgtcttccaaagtggttgtactattttgcattcccaccagcaataagtgacagttcctgttactccgcatccttgccaacctctggtgtttaacagtgttctgtatcttgatcattccaataaaagcacagctgtatctcactattgttttaatctgcaattccctgatgacatatgatgtagagtgtctattcatatgcttatttttcatctgcatgtcttctttgttcaggtatctgttcagatcttttgcccaatttttaactgggttattattattgagtattaagagttctttgtatttttggggtaccaatcctttgtcagatatgagtttctcccagtctggggtgtgtctttttatttgtctttggtgtagttcacagagcagaagtttttaattttaatgaaatctaacttaccaattttatgttgcatgaattatgctcaaggtattggagataaatagtcatggccaaacccatgattacctgattttttcctctatcaccttctaggagttttatgttacagtatttaactttacatttaggtctatgattgattttgaattaattttcatgaaacgtgtgaggtctgtttctacattcatttttttttagcacattgatgtccagttgttgatgcaccatttgttgaaaggacagtaatttctccattgagtattctctgctccttttccaaagatcaaatgacaatatttgcataaaaggcagtaattttgacaatatttttaaacctttaaacataaatgaaattatagataaacttgactttattaaaaccctaaacttcccatcatcaaaagtttacatcacatcatgtatacctaataaagtgcttgcatataaaagaaataaactactcctataaatcattaagaagtaaactggacacccacatcaatttttaaaagtggaagagaaacttgaacagttataacatgaaaaaaactattcattgtcgataaatatttgaaaagttgttcagcctgcatattaagctgtgattagcttctactaaatgcctacaaagtttgttaaaatttaagacaaaaattgccaaatgtgggtgatgatatggagctttggaaacttgaacaatgctaatggagagtttaaacttattccttaactttagaaaactggcaaaatttgataaatgtaaatttagtagattcgtaaacatgctcactatagtacaagagattttattgtttggtaaaagtgcaaaagaaatgagtgtaaatatctacaaaaagacatgctggagagtattgatatcagcattatttataatcatttctattagaaataatacaagtttccatcaaaagaagatagcaaactatgccataatgctaatgaaaaaaacatacaatttggagtaacaaagattaattttgcaaatacaataggagaaaaaatctttatgtatataaaattatataatgtatagagagctagctttatgggtctgcaacctgtgcagttgcacaggacccaaactttgtttaatcttctattatcaccatctcaaaataaatgacctttgaatgacggcctcagcattttaatttttcatgtggccctccctcttcaattctgcagacaattctacttctatttatataaatgtaaaaaaaaaaaaaggccaaacttatacatggattatgtcagaaaatgattacacagaagaaagagtgggtgatttcggggaaatatctctggatacaaatattaaaatattatttatctagctctagttgctgttacatgggtaggttcaattgttgaaaattcgctgagcacttttctgtatatatgttatattttaatttaaaaatgttttaggaaagatttactttttgctgatttttacattaaaactcaggtatcttaaaagaatttttaataacattagttacgaggtccagaactttgctaccaatgagcttgtgattcaattgtctgccctcagcagcaaataaaataagtggaagcctgaccattacattatctgtatctttcactaaactatattttgtgggctggttatttttaattactctaagtttaaaagacaggtatattaaccactcatcacattggcatgatgaaatatctaagaattatgaaagtaaatgagaattttgtttgattcctctgccatgatattttgcatgccccttaagttatgtgaggtattcaagtaagccagtaactttcaaaattcagaggaaacaaaatagcatcttactccagccaggtaaaccaattctgcctagtagccctaaaaaaaatgctttgatgtcttgcagtggggcttgaggtagataccgttcttggtgcccctctagatgacaagttagtgggtgcggtgcaccagcatggcacatgtatacatatgtaacgaacctgcacaatgtgcacatgtaccctaaaacttaaagtataataataaaagaaaaaaaaaacttaaaaaaaaaattagtgtgtcatcccgggaaatcttaaatgacacagtattgccatacagactttttacagaagaggttgtttgatataagtgccccttattgtacactttgaaatttggttttgtagcaaatcatgggtttattttttagaaatggctacagttgaggaagcatactttaacagacaaatcaataaaactagataaagttccatcaatgaagaaatcctggtcatttcaaactctgtctcccaattattatcagatacatcaaaagccaactgctaaaaagagtttttcttcctattaaacttttaaaaaaattgttatcctgttttatgattatacaaatcttctctgtatgaattatatgcagtttatgttgagaatagaattgtagcttattttatgaataattttacagaaatatatttatttttcttaacttgagatgatcagaaagtgaacataactaaggcatgcatgttgatttttgttttgtttacattttcacttctgaacaaatagtggcctttgtgcatagaaatagctgacacaattatcaaattatctgtaaagattttccttagatttgaaactgtagccagtgctggtagaacctggcagtctttgaaatcttgcctttctccttcacaatcagcctgtggccgtacatcagaaatatccattttatctctgattgcagtagctgggactctatcgttaatgttctggcttcccagcagggccacactattggaagttctgcttcagggtgtccttattatttttttttttctactcacgcacactactcatgactgacccacttcagtttgcagtataagagctgtttcccagtcctaagccagatggctggaggattgcatttttatgtttagatgatggtggccatcccagccccacacacccacccctggagcaaagaagtagcttttgatctcagtaaaagacaacaaggattttgtgctttcttttcctcaaaagaaagctgttctacttccctaaacaaaaggaaatggaaacaaaatgtagatttttgagcattgcttgccacagggtgtgccatactagggagatagctgcgatgtgaagtagagttgtcagttatcccgcagtgtacaggagatattgtttctaggaccccataccaaaatccgtgcacactcaagtctcttgagtaggccttgtggagccagcctgtaggaaaagtcagcccttactgtctatgagttttgcatttcctgaatactgtatttttcatctgcacttggttgaaaaaaaatctacccataacgctgaagcaggaagatcgctttagcccaggagttcaaggctacagtgagctatgatcacaccactatattttagcctgggtgacagagcaagacacgaactcttaaaaaaaattgcttaaaagtaggtccactgttttgtgtttgaacaacacagttaacaactatgttgttcaagggacaattttaaaaatcatttgcttaaaactaagggagttactgcaacaaaacaatgacagcaggggaggctttgggtcaaagaggaatgaacagagcaaaggacagaagtctcattcatcaaagccaagaacatggaccaaaaatatgtatacatgaggaaggaacagagaagagagagagagattcaaacactattaaaaaatgtacagtaaggtttatatccaagaaattcttgattgagagaaccaagaatatcatttaaggaagagctaatctgtaaatctggctatctcgagactttcagaggagaaatgaaaacatattgttggtacaaatacaagaaaataaggatgcaggaaagagaatggctccctgctgtgtgcttcccaggcagaagaattctcaaggatatttttaagagcatgagcctcagggttttttatttcagtttcatttgcaatcacgaaagaccagtgatatattggaattcctgcacattcttaattacactatcaaattctctgttaaatttttgtggtaggctagggaggaataagaaaccagagaaagaaaatcactagattcgactaataaatatttcttttccaactattcttttattccccgctcttaatttctaaatcaaatattttcttctatctacagaaaaagtgagattaaatgagttaggcaagtctaactgtcaatactggatttccatggatatgaaagctgactacaccatctcttctaagatgcaataatcattatcctacctaccatgagcaggacactgtgataggacacaaggctggagtacacaggggactgtgaattttgaaaacttctaatctagctaaagactgagcaaggcaatttttgtggcctaacttttgcctttgtggacattctacccctgaaaatctacatgtctacaggtaaaccttcagatagagatatgccactggcacattagttcttctagagaaaaagtacattctgcttatatcttacaaatataagatctgaatgatctgtatgataaaaaccattctttacttttagccttctgtagttaaactaaacaacttctaaaatccaagttgagattttcttaaagttctgccaagttttgtgtctgccactccttctagtttgctcccactgtgtgtatcttatggaccacagataagctgaaaagaagttcatttaaaagaaatcttttgtgttttacatgaatagcccatcttacctagatgacaaatttatgaaattatattcagaacaaaagtaacttatttcatacctattgaagatgaaaaatatcactgcaatgatttgcagaaaccacagtaataccgcagcatgaaatattgaaataattatagtcaatcatttaaaagtgatgactgtcttaacgattactgtaattgattgaggtgagagcattttctttgtaccctcagtagcttggacatatactgaagcattatactaagaagtagtcatgtaaggaaataatttctcactgtagaaaataaggctgcattattaaaatcatatgagatactgaaagagcttctcttccagtaatatgattgttaatcaacttctggtaacaggatggattaacattagttgctaccattctttttctcacttgtttctggatggtttaaggcacttgaaattcattttccctattttaaaatgtcatctgagtattttggcttagcatctggttcagagattgtgggctgcttgtgcaattctctgccaaagaagtgccaatattgttctttaagatactccagagaactgagcttttctttatctcaagcctcctattaaattgttatatgtggtgttatattgaaacaaaattcttagattgtatacatgaaccccacttctaagtgctttttgactgggacttataggaaaacttatgagtaggaccagggtgtaaaattacaaccaaagttgtaagatttcagctctccccattctgcataccatttctacacacacacaccttggaggaagccccttcaccttcagctgcctgtggtttcataatctttcttctccaccattcaaaaacatgttcttaaagaagtatttaaagttcaagtagcataatatagtatccattacattataataacagggatatatgaaatacataactttttttccaattttttgttatactttaagttctgggatacatgtgcagaacgtgcaggtttgttacgtaggtatacacgtgccttggtggtttgctgcacccatcaacctgccacctacattaggtatttctcttaatgctagtcctcccctagcctcccaacccccaacaggcctcgtgtgtgatgttcccctccctgtttccatgtgttcccattgttcaactcccattgttcacttatgagtgaaaacatgaagtgtttggttttctattcctgtgttagttttctgagaatgatggtttccaggttcattcatgtccctgcaaacgacatgaagtcatccttttttatggctgcatactattccatggtgtatatgtgccacattttctttatccagtctatcattgatgggcatttggattggttccaagtctttgctattgtgaacagtgccacaataaacatacgtgtgcatgtgtctttatagcagaatgatttataatcctttgggtataatcctttgagtaatgagattgctgggccaaatggtatttctggttctagatccttgaggaatcgccacactgacttcaacaatggttgaactaatttacactgtcaccaacagtgtaaaagcattcctatttctccacatcctctccagcatctgttgtttcctgactttttaatgatcaccattgtaactggcataagatggtatctcattgtggttctgatttgcatttctctaatgaccagtgatgatgagcttttttcatatgtttgttggctgcacaaatgtcttcttttgagaggtgtgtgttcatatcctttgcccaattttgatggggttgtttgattttttcttgtaaatttgtttaagttcgttgtagattctggacattagcccgttctcagatggatagattgcaaaaattttttccccttctgcaggttgcgtgtttactctgacaatagcttctcttgctgtgcagaagctatttagtttaattagatcccatttgtcaattttggcttttgttgccattgcttttggcattttagtaatgaagtctttgcccatgcctatgtcctgaatggtattgcctaggtttccttatagggtttttaatggttttaggtcttacatttaagtctttaatccatttgagttaatttttgtataaggtgtaaggaaagggtccagtttcagttttcttcatatggctagccagttttcccaacaccgtttattaaatagggaatcctttccctgttgcttgtttttgtcaggtttgtccaagatcacactgttgtagatgtgtgacattatttctgaggcctctgttctgttccattggtctatatatctgctttgataccagtaccatgctgttttgtttactgtacccttgtagtatagtttgaagtcaggtaccgtgatgcttccagctttgttctttttgtttaggattgtctaggctatacaagctctgttttggttccatatgaaatttaaagtagttttttctaattctgtgaagaaagtcaatggtagcttgatggggatagcattgaatgtataaattactgtgggcagtatgaccattttcacaatattggttcttcctatccatgagcatggaatgtttttccatttgtttgtgtcctctcttatttccttgagcagtggtttgtagttctccttgaagaagtccttcacatcccttgtaagttgtattcctaagtattatattctctttgcagcaattgtgaatgggagttcactcatgatttggctctctgtttgtctattattggtgtataggaatgcttgtgatttttgcacattgattttgtatcctgagactttgctgaagttgcttatcagtttaagcaggttttaggctgagatgatttttttttttaaatagacaattatgtcatctgcaaacagagacaaattgacttcctctcttcctatttgaatgccctttatttctttctccttcttgattgccctgtccagaacttccaatactatgttgaataggagtggtgacagagggcatctttgtcttgtgccagttttcaaagggaatgcttctagccaaactaagcttcataaggagaaataaaatcttttacagacaacaagtgttgagggattttgtccccaccaggtctgccttagaagagctcatgaaggcagcactaaatgtgaaaagaaataatcagtaccagccactgcaaaaacataccaaattgtaaagaccatcgacactgcatcaactaatgggcaaaataacgagctagcatcataataataggatcaaattcacacataacaatattgaacttaagtgtaaacaggctaaatgtcccaattaaaagacacagactggcaaattagataaagagtcaagacccatcggtgttctgtatctcagtgatatgcaaaaaaaaaaaaagcttttattttgctcatacttctgagttttctgagtcttagatggaggtcagcagatatacactgagtataggtaggggcacttaaatggggcagctttgctttgtgtttctctcttccatcctccgataccatcagttttcattgaatctgcagattgctttgggtaatatcttaacaatattgtctttctatccatgaacacagaatatcttttaatttatttatgttttatagtttttattgtacatgtcttttaccattttggttaggaaaattcctgattatactttttatactattatatatggcattgttttggtagcttttaagaatgtttattattagtatataaagatgcaactggcatttgcatgttgactttgtatcctgctactttgctgaatttgtttattactgttaataggaatttgtggaatctttaagattttcaaaatccaagagtgtacaaacagagatgattttacttttcctttccagtttagatgacttttttcttgcataattgctctggccataacttctactactatgtttaatataagtgccttgttcctgatcttagagaaaaagctttcagtctttgaacatggagtacaatatttgctacgactttttacatatgatatatatgttgaggtagtattcttctactcatatttttttaagtattttttattctgaaaggattttaaatctaccaaatgtattttttcaatcaattgagataaattttttcttttcattctgccaatctgtatattacattgtttgatatttgcattttgaaacatccttgcattccaggaatacatcacacttggtcatggtgtataatttaatttatttacatttaaagtaattactgaggaagggcttacctctgccattttgctatttgttttctatataccttataacttttttgtctctcatttcctatattactgtcttttgtttttagttgctttttgtaccgaaatgtttgacttcccttctcatttcttttgtatatacagaccatccttaacttatgtttggacttacaatttttcaatatacagtgagtttgtcagaatgtatccatattataagtcaagaagcatctgtattctaaaactattttttgtggttaccatggaaattacatttaacaacataaagttataacactctaagtttataccagcttaacttcaataaaataaaaaactctactaacttacacttgtttcacactttttttagttactggtgtcacaaaattatatcttagtacctgtgtccaaaaagaaaaattaataatatttcatgcatttgttttttaaattatgcaaaataaaaatacagatttacaaaattataatgctactaactttttgactaatgattttttaattgttagtccttaaatcatgtagaaaacaaaaaaaatggagttacaaactaaagtttaaatagtactagcttttataattgcccagtatatttaaaacctttactgagatgtttattttttcatatgacttcacgatacgctctagtgtcctttcattacaatctgcagaattccctttactgtttcttgctgagcagctctagtggtaatgagctgcttcagcttttgtttaacttgaaatgtcttaatttctccctcacttttgaagaacggttttgacagatataggactcttggttgacacattattttatttcattttatttgtagccctttgaatacattagttcaatgctatctggcctccaaagtttctgatgataaatctgccaataatctcactgaggatcccttttatgtgacaagttgcttctcccttgttactttttaaattctttttttcttttgagattttgagtataatgagttttattgtgaatctttttaagttcatcctaccattatttcttcaaatattctctccctctgttctttcttcatcttttttttttctttttttttttttttttttgtctgagactctcacaatgcattttggtcagcttgactgtgtccctctcccacaggtttttttgactcttttaactttggtctcattctttctgtttctcaaactcaataatttcaactgctctgtcttcaacttcactgtttctttcttctgcctgttcaaatctgtctttgaagtcctgataattttttaattattatttataaaatttattgtatttttcagtgctagaattttttttgattttgatatttccattctgtttatatataattttctggtctttttccacgtcttcctttagtgttttgagtatctttaagactgttgttttaaaatctttgtttaatacgtcatcacctttttcaaggatagttgttgttgttgttttatttcctttgaattggccttacttccctgtttctttttatatcttagaattttgtttttgttttacacagcagacatttgaaactagtattgtagcaattccaaaattctactccttccccagagtttgttgtttctgttttgttttgtttgttgtgctttggattatcttatgctatctgtctactaaagattagcctgaggggtaaaaacttaatgtcatttcagatttttttttcagtctttgactttccctagtatgcatgatatctttctaatttcacccttatatgcactttttggagtgtcctagtctttaatttctggctatcaataatgggaaaagagaaaaatgaatgtgggaaggaagaaagcacacttgccttttaaatctcctggaagtctctgaggaggtggggaggttgaagcaatgaaggatgtgcaacaatgaccgttacctttgtgtttatattcccttggttagaagcagcaattagtaatccaaatatggatctctgatatttgtagaacaggatctttattgcctagatggctccaacaagctgtgtaagctcctctaggaacatgtgcaggctgcctaccacaggtctggggtagaagaatggatagctgtcgctgagctatgagctaaaatcccctgaaactaactgcaatttgccatccaattcttctgctggaagtttcaagctttcaatagacctaagtttcataattgtcacatcagagagattctgctgttgcattgttgtccgggtagggagacaggttcccggtgttttctgctccactatcatcccagaatcatctcttcaggcttaattggtttttgttttcttttgcttgttttgattctgaaaaaaaaatacttttcaaatcaagagttaattcacaatgttttcaaagtttatcacaataataatataattcggaaaataatgtttggtgataatagagcaattttcctaacataaaaagaaaagctaatattccgtgctaggcagggatgatgaggtgggatatttgtaaaaagaaaagagagaattgtgacaggaatgagagcctttgattattgttccccttttaatgattacagcacgtagtggagatgataaattacctagataggtaatattgtgaattttaatacagagatttttttctcacttatatgaaactattgaagaaggcaacctaggtgactgtccttccctaaaatggggcagtcaaccacaacagagtaaaaataactacctcacaggtctgggcagatgtagggcctatgtggtcttcaccatggttgtcctcatatcaacaaagggatgaagagagccacagatttgcctatatttaaggagattccaaagttgtaaagttgtaagcaaggaaaactcataccagaggctgcactgtgaacagataagcttaggggcagctagagaaaacatctgagcctctgaggatcactggtgccagtaagatctaatgcagggtggattcagcaggaggaaaccaccagctcccctcaagcacccactttgcattgtttgtgatatgaaactagaaaataagaaagaccacaaatatgaaaaagcagggggaaaaatcaccttagcactgattcctttctctcaatataagaaggatatatgaggtcctgtggaactcagatcatttctggtaagagaagaaagaaattgcaggcagaaaaatgcttggtggaggtgagagagtgcttaactaggagttaaacaagagattgagcttaaaactagaagtaacttcagtagtaagaataaatttttggctaccattttaagaaatggaaaaattaagaaacttttatctctatatattcaattttgatcctatgttgaaaagtggccattcttctttccttttcctctccttccctcacctttccctccccttcctcctcctcttcttttctcctcctttttttcttcttctttctcttctctagctctccctccccattatctgttatgtgtatattatacattcataaatatgccctccctcccccttatctatcacgctgtgtatatattgtacattcatatatatgcatgtacataatatatttcaatatctatgtataattatatataatgtatattatatataattgtataatgtataagtgatgatgttattaataatcagttaaagatttgtttacgtagtaaggtatatgtgtgtttgtgtatatatacgtgtgtgtacatgtgtgtatatctatttatattcttaatacatatctttatatatgtttatgaattttttatatttctatgttgtatgcatacatatatactcctaaaaacagggttgatgtaatatttcaatttttacacaaaatgaaaccaagagctctgagataccaatatatttcggctttgtcctattttagtgcatgtctaagtcttttactttgaaatccttttcaccctatctgtgctatgtggtaaaagcggcactaacttctgcctcttcttttgataaagtcccatcttttaactcattttctatttgtaactcattaagtttggctctgagaagctctgtcgtgtaatctttactcagcacaagatgtgcccatgggtttactgctgccggccctttcctcatctcttctcatcctcctccactctcaggcctgccttcaaccctatgactcttctcacctaacaatctgccgctgttactgtatctgtagccttctccaatgatgcaaaagagggtcacagcccacgagaatatgcacttctgcacttcaggcacaaacagcagctgtgcaaggcgcaccaagcaggctgtggaaggctcactctatcatagatttgcctataatatgccttcctattttgaccccgagggattcattttcatcattttcttatgtcttttcaagcagttttactagagagaaagttaattatggatttgtaataatattttccgagaatgagaaatagcatttctatgaagatttttcacttctaaactactgtaagctttctattaccccaacagctttccttcaagaagctacaagggttttcattttgaagttaatcttattttagcctcagatgctctcaattagctgctgtctttgtttcatgagaaattgcttttgattagcagatttctttgtttacatggttgctcagaccatattgccacagaagagctaatttgctacccaactgcttctcttctacattaaagatgggtagagtattacagagaattttgcctatatttaagttattacatagtaaaatatgcctaaagttttaccagatagagattattctcttataaatcatatagtgtccttatttaagcttaaattcggtcaccaattcttaaaatagggggaaaaagtgagaagaactttttataacattaattatagctataacattgaacattaaaatactgtatttttaaataatatttgtaaattctaagtatcaacctcctacatttatgctgttggagaaatggagtctccatacggaatcttttcttctccaaaagatgtttatgattcagaagcaatggtcaaaatataaataaataacatcacaaacaagagtttgtcatatgacaaacaaaaaatgccattggggtaagacaaaatagattatgattaaacatttattattcaccaatgtttgagcaagtgcaaatataaaaacaataaagccttcttaaattaagagtccaattggtatatttctgaaattatcatctctctgctcatttatttgcttactaattagtaatatgcatatatttcaagttttagggttatttattttgtgtgtatggtgctctaaatttttgcattaatattatttttaattgataaatcatagttgtatacgttatggggtacaaggtggtgatttgttatatgtgaacaatggagaatgactaagccaagctacttaacacatataacacctcacttacttaatctttttgtggtgaaacattcgaaatttagtatctcagttattttaaaatatgcagtacattatttttgaccagagtcactttgctttgcaatatatatcaagcttttaagctagttgaatttattaatgtttccctctggacatttatttttccctatttttcataaattagttcatctctatttcaatctattagaaaatgttaaccatttacgttaaaaatctcattaaatagcatggtatttgaagggtctttctttcctccatgtttttttcctttccttccttcctcccgtccttccttccttccttccttccttccctccctccctccttccttccttcctacgtttcttctccttctccttctggttctccttctcctcattctccttgtcctcctcctgctactttctttctttctttctttctttcttttctttttttctttctttctcttctcaaaatagtaggcaagcaatcctaatattacatttattaatttctattgtatacctgttactgaaaatataaaattatattccaaagagaaatagcttctaaagaaatcaaactgaggtatgagaactgcttaggtatgtgtattgaattggacgtgtagctgttgctacataaatgaaaactcttctgttgttgactctattgtagtgtaggttatcaaatattcaacggtatgggtccactttagctcagacattctagtcaactagttatatttctttttcataaatgagatattttgggacatttatgcattccattgcttttttatatccaaaattttctgtcaaaaaatcccttctctgtccatatctagaaaaatatggatggcaatgtagagaaaaccagtctgagcacagttattgaaactgagtggaaaaatctgcattggaatgttggaaaactaaaataaataaaaataaatagttcacttcatgataaatatttcaatagatcttttaataatatgccccaatacaagaaatacttgatgatgtctgtaatagtgaatgtccttatagataatataaattgactttaatggaatatatatatacattttgctaggtgtgaggatttgtggtttgaaaatccatctgtattacaacccttctttgattagtatatgcaacttatattacaatgagaatataccctctttcatcccaccatgtcttcaacaaagaaaaagttgattgttttgatattttcctagtgaatcaccttttaaaccattgagaatcgtaacattaaattgaaacttccaattgaaaagcactttaaactttacttaggaatacaaattattcattcttatattgagttgaaaatttatctgtatggatgtcatgggttttgtcattgcaaagtctaaacaaaattgaaagagcaggaagtttctcctttcttctctcgcctttctatatttcttgcctatttcttgagaccctaattcctgtatttcctgtattgtattctacatttttagtagcattaccctcccgatatttaatgtggaattttagatgctcaaaagaacaaaaagtcaattatatagttttaagcactaacaaccaatctaggtaaagtacattttatatttgagttggggtcttttgccttcaataagactgcaagggctgttggtagtgttcaattataaggctaaacctagtctttgattttaacctttattatatgtcacatatatgtggactgaagacagaaagaacaatacttaacaatgaaattaaaataaagaaaataaaaagaggatttaatctctctacataggaaaaattgttaaaaatttggtgtgtaaacttatttctttttccagtaagatacaaacacagactcagacacatatttatggtaaaactgccttcaaggttgttgtctgtatgtctaacactgcaaatttaacaagataacataagtcacctttaggctaataaatattcataaactatattttaccttgaaggactatgttattatttggaatctaacaaagtccctagaacaggacttcttatttgtacaaaaatactattattctatgcattgctactaagaatgtccttacagcttatttgtggtccactcctttcacatatttacttcagaaaaattttcaaagtaaaacacagttgtaaatcaatattaaagctatctttttatccctttgtaaataattttggggatgatttgaagataactgcacattcttattatacagtcagaatttttccactgaaataatacattttaccctttaagtttttgtcatttagtacatggttactttaaagaagagattatgaaagtaattcctggattttgatgaaagcataattcctacaccaagttacaaagtcccatgcttgagtaagagtttcttctttcaatatacactttcctatttcagaatacatgctgttaaacccttctttttcatcagtagaaacagaaatagatcacatagaaaagaattgcttgattttattttgcctcttgtgaatccattcttatgcttaacctcaattataaggaagtcatttttaaaaacataatatcttcctataaaatttgaacccaaatgtaaataatttttattttatttcacataatatcttttgcttatatctaaactaacatacaggttgagctgtattgaacaaaccaacattattcagattaaaaaataattcaaattagaagacaatcacttgattttaaataactgagcaattctccttggttgtgaatgtgtgtgtgagagtgttcctagagatagaagaggagggtgttcatggggagaaagagacaaaaagaaagtaataccatacataaattaaaagcgtgtgcatgtgtgtgtgtatgtaaattgttgagtatactcaacagttagaaacataaatttaagtgaaaattaaaagtttaaatatgttttaggtgtaaatgtaatgattaagacacaaatagaagctgataaaaattcaattggtgcataatggaaagaaaagcaacaaaataaattagttcacaaagctgcctgtgcgttccaaagtcacattagattccacgtgcagctttcttgaacactcatattatctctgcactctccatctccatcatgaaattacatatgatgaccactatcatctctgattccaggagaaaaaagattttattccttaataaattaaactgattccaaaaataatgaataaaaatgaatcttacctccatgacagagcaatgaggataacaagagagccaggcagcaactgccttgatctaagttgggtgttagaccaaacgttgggctgagtgagggaagagaattttccctgagacagaattgaaaaaatgttgccctgagaaactggagtaaatattgaaaaaccaaacaaaacaaatctacaacacaaaataaagaaaatcagtacaaccaaaaaaaagaaagaaattgtatgtaattttctagtagagtatatttattgaacaaatggaaatgagtggcacattcattacacaggaactgtagcttcttcttgataaatgtggaaccaaacataaacaaaaatatcacaatcccaaagctgcaaaccactaccaggagcctgcacctggaatgctttgactttgagggacatattagcacagagcaacaagagaactttgctgttatagaggctatgagactatgagatatgtgaaataaacatggaactattttcctggaggtaaatgtacctttagaaatgacagaaattaaaataaggagtcaaggaaaagttctatcatagaagaaagactgaactcttagagatcaaacccactatcaagatttaatacgaaaagagatgaatgttttgttttcatatcaaagagcatgatgaacagtcccaacaggcttaacaaaagaggtcagcaaaaggatttgagtacctgtggattcgttagcaagatactaccttaacccacattgagactataactgaaatctcccaaaagagaaattgtatctataaaatggttgaattatactctgaaggctcctgggcttagaaaattattcttgataagaagaagttgaaactaaacaaataaacttaacaagaagacaagagaaaggtaggcagatcttacagtagaagtatgggagatctgcatgaaatagattcataaattgagaaaaaggaacgacatggactatgaaaaagtaaaaatgcctgggagatggagaatgtataggttaagactgaaatggtaaaagaagatatggttcagagaaggggagccaggtaggattatatcagagtccaaagctaatttagatgatggagtaactatgagaagatacgttcggaaggatctattccatcatcaaaagcagatatcgacttgtaaaaatatgacaataggtgaattactccccaaaccacactgcctttttctcatatttaaatctattaattttatttcctttggtccctgtattactgaccccataatgctgagccagatgtgacctcagccttgaagaccctctactttattatgaacaatgatcctttcttgataactacttgaaagaaataattccttgaaagtgataatttcttgaaagattacaatatttttataaatctaagttacaatatataactgagtctccactgctgctgtgtcctgcataagggtttcttaaaccttcgctaaagagtgaaaacccaaccatttgtctctctctttattctcttttttccattggcagagattggtagaacgcctccagcttggacatgatcttgcacgttttctcgtctgttcttttgttcttactcttatgtctatccaagcagtctaaacgattctgaactcagatttcagcatagggggaagagatggtgaaaacaaaaaggtcccatgcacacgattttgtcaagtttaagcatgtattgcaaacgatgcccttcttggcccaatcccgtgtctcagagcagtctgcaatgagaatttaggcagaatccacacttaccaataaaataactttttctatattaacttggcaactctgttgtgcttgtattttcccaagggttttcataaaagggatgtctgtggcctgaggtaggatttgatgttctttgctcttctcactataggaatatggctaatttactataatcgcttatttatttttctacatttaacatcctgatttatttcttctcgaagaaccttcaaaaattactgatatttgattaattgtcttaatctaaattttctttggaaccataggattaaattaatcctagtcaagaaatttgagccctatttgtaggtactcattttactcgtcacttttagattttctttccctaatataaatgtttattttgctcagttcagatgtaaattttaaaaattccatgtatttatcataaagtccactcttaaaatggcaaagtaaatataaaataagtatatttgatggttaaataaatcagatttcaaaaaaatgataaatttgaatgtaacagctccagtgaatttaacgaaaaataactaatgtctttagcagagcattgaattaaattgtatttaaataaacaattactactgtatgacaatcgaatgactttcagtcacaaatagcttttcaattgaaaaataaaactagatagcaaacataaaaacatctaaacattgccaataaacaaatatgtgaaaagttaaagttaccaacacgatgtgtgtaatcttggcaagttttagtatggttattgctatgtcaaaaacaaaatctataaattggatattaaaaacttaagctgcaaaggtgtacattaaactagcaatgattgtcctatctggtgatagaaatcttggtgatgttttttcttctccttctctttctttttctcttcctccttctccttctactccattttctcctttattcctcttctatttttaaactgatgatagtgtgaattgtgttagtaattaaaaaatatacattttaacatcaagaaaaacaacaaaaaataattatcacattacctttgtaccacagaaaaaaattggggatattaccattgttttgggttgctttttctaggtttggtaaaattcttaaaacttgcgtgcctaggctttcttcctctttaaggtgtgaagtgttttaattgatcaaagaatataaataaagaaaaaatatctcagtgcatggcttttaaaaataaaattaaagtaatgatagcacaatctatgcatttattttttttttctcaaatttactaattgcatgtcaggtggtatactaggttcctggaattcaaaaaggtatagctacatccctgctgaaagatcagaaccaaccagcctcttggacgtcttactactcaacaatgaaccgttagtttcatcagcagtgtatttgtctttattagtaaaaagaggcttctttttctctgctatatttatttttagaaaatgtaccgtttttaacattttattttttatactatagatattatatgttgtttaattatgctattgaaaactcttcatgtcattaagcataaagttgagtttaaaccatgtatcaggatacaattttgaacatcagcatacatcttcttcccatcgtttttcttcctttccctctccatcattcaagcagataatcattgcctaaatcaagaagaatgtacaccagtccctcttggttttgggttccaaaagcacacacaattaggaggattctagaaaagatgtatggttaagtaaaggaagtttcaaggccatgaaaatgtcttggccaaatagagtaaagaacatagctttatctctgaagtgtgagattccacaaaaatgggaaatgaatgaggagacaggattgggctgagagtaatgctggcaggagtttaatactgaaattaattttatcattttaaatagtcagcctccagttcccctaccttgtttcctttcagtaattgatatctctaactctcagtacacatactgtgcataggaggacaccaacccagctctagaactggacacaggatcaaaatcagactattgtgcatttgtagtgccgctgattgactcagaaatggttattggttcagaaatggttatgatctcagccaggtgaataacaaactaccaagaacgtttgttaaaacaattgtcaaagagaatttctctctccaccaggataactttggtaaacataaagagaaaagaatctgcccacagattcagccaaatgagaggagagcatatctgagatggtgaaggaaagtgaatcaatcctgtattgttttctgattcagtcacgcctatgggagagaaactggttttatgcactggtagcagtgagaaaacagaaacccagggagaagataactctgttctgtctgtattctggcagagtcagaaagcaaaataggtaagtaaacacacagagaaccatagagccaaaaatgtaatgccaactattaaaatgagcgtctcaacagactccttcaaatctaaaatacctgtgcaataaattcacaactctgggaaagtataatgacaacgatggatgtgggctggaaatgaaaaataaattgtagaaaaaatagtttaccatccttgtacatgtgagttgactaagattcatatacaatacatattgtatatgtgtagcctattaggttgaatgaaattctgaaatacttgggaggcatttagcatttcacataaatagttttgataaagttctttcttgaggcaagagatagattaaacgttcttttgagatttttttcagattaatggttcaatagtattgcttttatgttcagtataaaagttagtgtttatacttcaaaatcagtggcctttatgatttctaatattctgtgacagtattgttatttatataggaaaaaacttgagtctccttaagcacagcataataaaagttatgtagtataaaagaattaaattttctttttcatctttggtcactattgttttagatagcatggcgtacttgttcatagatcatccaaagcaaaattgtgtagcaagtgaaatcagtaagcttttggtgactctctttgtttaaataacaactaggcatctataatcaccgtggtgacttttggctctcttcattctgacaagggcatgtgatatattacatcacaattaagagtctgaaaagacacaaaaagaaggatcacagtccattcctccagttgttagctgtaagactgggaaaattattaactctgaaattctatttcttcataagtaaatttacataagggttatttcattaaatagagtaaaaatatgtaaagtagacacacattttagaccccctttaatttcatatacttcttaatcaaactttgctgaacctaaactaattcattgtattcaatatttgattaggataaaatctcagactgaatcttttttaaataaaacaacctaatatatttggccaccaaaatatttcaaaataataacataatgttaaatgctttttaattgcatttaatcctcataacatttctcatgggttagtatatttctgttttccacatgggaaaactggagcacagtaaatttaagtagctttgcttaaggtcacacatttaggaagtacccaaaataggatctaaacacaggctaagtaagtccaaaacattaattctcaactatgctttgctatagtcgtagttctacttataattgatatgacattgagatgaaccatgtattttctccctgcttcaaaattcttgcgtgtagtataaggaactgggacaaagtaatctctaaagcaccttctggttgaagaatttcattctatgagacaataactaagcatgtgagtgattcattaattatttattctcgcttgctctcattctccctctctttctcagccaagccataattcctatgtaaaaggcatataatctacaatgattcactaattcaagtctgtctgtctgtctgtttcaagggtcattatactcttcattatttagaagaaaagttgactttccttaagtcttttgctaaacctgtcctctctataataggttctcagccaattacatctttgcctacaacactctcttttctacacttgctctttcagttctttcactgctgacaaccacatgaatctgggcattaacatcccaccttccctgcaaggtgctgctggtcataatgacatcagtgaagggtgatgtacgaagtgatgggaagtgaagagcgtgcaagttaaagggaagtgccatctcttcacttcccaccatatgagcatctggtctgtgcaagaaaatttactgactgttacagatattaagatgatttgtaccacagggagtgctgtgaactaacttgggtcaattgtgaacagacaaattattcacaagtttgtttgaatagaattcagtagattcataattaaagttaggtgagtcctatagcttcctccctccccgatctccctcacaatctcaaaatcaaatgaaattttataaaagcaaattatgccaccataaataacatttttatcaaataatctgcaagtgttcgtattgttttctataaaggcccattgaaactttaactccctggtttttgtttgtttgtttgttttggtgctaacaatgaccttacatgaaatgagctcttgaaataatggttataatagtttactgactaattcagctaacttcttatgatatttgacagcacaatcttccaagggtaccccgtgggctgtgaattgaaattcaaatggtataggttgcaaggttccccaaattctaatactcttgcacattcaagcatcaaagtattagtatgtttctaagcaatcaatacatctgggagcattacttattcctcagtaaaaagtaatttctcatttttttaaattaacagttcctttgtgcatgtgagggtaatgtagctttagatatttagggccttctaaataacctaaccacccctggagtatgaactgctgattagaatacagcatatgttagcaaataacaaacacttggcagaggctttgaagttttatgttttgtctatagcttgggtctcatctagttgtcacaggattccctcactagcctattctctaattaagaggagtcacagataactgtatcatctctctttacagagcacatttcaagatgagaagtagggacagttgttctttttccttaactttcatttaatttgtttatgacataataaagtagataaatacatgtagataaactgtgaaagacctttacatgaagtctataattaatacaacagggctttagtgatgataatggagccaaaccatggaagactgaggctgacaagtcacagatgttggggaatctaagagctgtgaattaagaaaaatgttgaaacaatcagataaaatttagatgttgaaaattacatttataaacaagaataacttattcaatatagttctttatgtgctctatgtaatttataaaaatacaattttgaaagattaaaatcatttcttaaattatactaagtattcttctaagcccaccagccaaagcacactggagacacagcctgagttaaataaattatttttatttagcctcttcaacagtttattaactaatttattcaatagttaaatcaattattttatttagcatttcagaaaaggtcttagaaatatctcacaaaatggagtgaggagacacttttattggatttagttttgtagtgaatgattctaaggaaggtaaagtgaagaccaactgtggattggatgctgtcaagcaagcagagcatttagcaattggatagttcagcaacatttatttaggagatgagatcaatgaagttagaccaaaatgtcattggttcaaaaaaaaaaaggagcaataactcaaaaggaggggttgttattcattttacagccatggagggttcattggagaagcattgtttatatagccttgttgaagtctcatggttaacattgctttacgtcctggtaggaatagcacagcctgtttatcaacaggggtggctttcacttttgaatatttatgcttctctctaaatgactcaggatggccaaccatttactcattctaaaattgtttgctagaaacttattatatgttaggatctgactaagatataaatcctgcccttcaaaggatgtttactctaccagggaggagaaaggtattgatggcaattattgtagtatattggcagtgggagcattcaacgagagcattattgctgcaaactgacccaggccaatttagtggttcagcaagccacagttgcctttggtaagattgttaggctaataatggatagatatctttaagaaccgcatatccaagtggaatgcctgaataaaagtaagtctaaggccaaatttcttccagcatacaaacattactaggaatctggaaaaacagtcatatacttattctacatctctgagaatttccatttgctgaccaaggcaccataatttaagcattttgtacaaggatgacttggaagtaggtgagaaaatacataaacagaagaccagccagagttgtaactctgtgaagtggcagatcctttgtgaaaaggagggaggcagagccagtaggactctgtaccttgaaaagtgctccaatagcattggttgggccagattctacacatttcccatgcagagcttgagatacatgtatgatattttctacctgttaaaactctgaactttcatttcaccataaaaatattctaacatcatttctactaatgaataaacttaggtgacaaatttattaatcgagtttaaacaatagattgcattaattacattgattctgactccattgattcatgactggagtaagcataacactataaaagcattggtttttgatttggttaccttaaatactaactaaccatgcctaggttctagattacaggaaacatacatatacatatacatacacacacacacatttatgtaaagcacacacatatacacatatactcacatgtacatgcacatatatacacatatacaaatgcacatatacacacacacatatatacacattatttctctcttacatgtgagaaaattgaggcatagtaaatttaagtaactttgctgaaggccacacattttggaagtagccaaaatagaatctaaacacaggactgaataagtccaaaacaataattctcaactaagtcctttgcgctagctgtgtatatatgtgtgtataaatagatatatgtctgtacatgtgtgtatatgtatatatgtgtttttatatatacaaatgtacacatatttgtatatatgtatatatatatttatgtgtatgtgtgtgcatatacgtataaaatatatgtgtatactatgtatgcacatgtaacacataaatatgtatacagagaaaaatatatatatacatgtatatacataagctctataatttagatgtctcttcacaacttacataatcttatctaagactgtgttagatagtcttttcttagatatctttgatacttttccaagttttcaaatagatattgaccctagtttcaaaatcccagaaaaagcctcaccacaggtaggctccttcttccagtctctgaaatctcttattctattttccattgaattttctctttccttcatttgacctttcctttaacaaagcttaagagaggaccaatgaccttcaaaatcatcaaaacagtactccaggtagttggtaccaatcaatgattgttaggaatcaagatgaaaatcatttttgattattggtagagctgatatgatcaaatgagtatgtaatatttctaaaatgtttgtaaagtaattcttggatatattaaactttaatccatttgtgtagcctaaaatacggtttcagtgtgccagtgtattaaagagctttacaaaacacacaccctgggcttcctttgtaaaaagtaagccaaacgtgttcctcaatgaggagcgagttctaagaaatctaaaacttatcccgcataaccttttaagtaaaaacctttaaagaatattttccccaagttcttttggctttttgtgagtttctactaccttttatgcttgacacattttcactatgtgtttgccaagttgtgctttaacatgttatagattcttccattcagcttccagtatgggctacgtttaaaaacagctgtgcttcatcatcctttcttttgtccagagaatactaagtggtaacctgctgtcatgcggctgccagagcaaattagatgctgtgattcctgtgtagtgccccaattacaagtaaggagggcacttaccgtgcagtacttgtcttgatgtaagggagtcatagatttcaactgaaaaatagttgtccctaagaaggacactcgtatctgcctacacatattagataacattttgaaattagaaaacagaggggttttttttaataagtgcctagccttttgtaaatatcagtgcatataagtgatcaaaataccaattacaggaaagaactttgtataatattttgaattaatttaactatgaccttgatagaatattttacacttgaatctttgcacagtattaggccacctttttttatcaaatggaatgacctggttaattctacttaaaatactttaaaatatatatttacttgcatgacacatattacaatgtttatatacatagatatgtcataaaatcatatataatatatactaatatgcatgcatcattttagattttgggcagatacttttgtcttgtttcctgttctcatgagaacatctaaataatatgtttctactcttgcagaaatcatcaatcaattcaaatccactgtttccttttgactgttggctgttttgtttttcaatgttttgtttttgttgttttgtttcatctttgcatggcagtaaataaatagctaatggtatacaatatgcaccaggaactatcataaggacctttatgtgcatttttaaaattttattttccagataactctaagattgtgcttatttttcttttacagacaaaattggggatgggaaggttagataactggtactggtacaggatggagtaaaataaatcagaattctagagccatgatacatagtcctgtctgtctgctttctgatgacatctccttgtacagcacctaaagaaatgggggaacagggacactttctgattcaccttcgacctgatggtagttgatagagaaggaacacttgatacctcctacacgtcatctaactttatgccatgatctattccatgctgcactctctttctgtacttttgttcatgttgttgctctttcccttcccccatcccagcctcttcacttgatgcccattctttaattatttattccaaggcctcttttctgatttaaaagccccttgatcattccagactacttggatctcaaactttccaagctcctttgctcttcctgactgaaacattcaggcagcaattagtaaaatgccacttgtctttttaaaaacaaacaatttcaattttttattatagattaaggggtacatgtgcaggtttgttacatggatatattgtgtaatacacaaggtaggaggtataaacgaccccattacccaggtagtgaacatagtacccaatagttattcagctgtctattaaaaggtataacttaatttaagacttcactttttatgctctgtggctatgaagtaacaagcatattttctctagctatactgtagaattggtcttctgagtccttattcagtatttcttatatgtggattttttgcctctccttctagactgaatgatttttgtgagtaaagactacatcctccacattttttaatgccacagagttttagtccaacaagagcataataaaaagtgtccaaaagtatttgatggattgaactgaatgcagtactcagtaaccttagggccagtctggtgctccagacactagattgccctacttgttatgccactaggattgacattaaactttgcaagcatgtacatgagcagttcaaaataattcccaatataactcaattctgatgacatttggcactactgcactttccagaaattgatggaaaatgtcaattcttccctgtggtagttttgccaatttcaactaaagtgaaaagtagacgtgtcgctgggcaaaagactaattgcttccagagaaatgaatgggccaatgaagaaggtggtttgcttccaaaaaacatgcaccctcaaaaggatatagtataatactgatattagactgagcatatgaacattgaaatattttcattaattaattaccaggctgaagtcacttactttgaccaatatagaattgctgtaactttgagtgtaatgtaaaattcgttttggtaaatttagaggaaaaagtaaaaaaataatttattctgcaaaccaataacctttggatgtctattatgtgacaatcaatccttacactaggcatgggggatttaaatttaataaataactagtacctaaaattaaggaaatgatgatcccatagagataaataaataagtacagttaattgtgatcattggtaaaaagggagaatttgtgatctgcacaaagcttgaagctctcatattgatcttggagttcaggcaaagaaggctacacgattgtgagctaaggtttgaagaataaatacaggttgaagaagattattatttcagctttgatatcattatccctatgcaaataatatatcctgtggaaatataggttatacaaagtggaagtgggaagaaaatagagtttgtaagacttggtgtggtaagatgtatagtttaaataccttagataaacatttaagaaatttcttcagaaaagtgagagatgttcttatattttaaacagaccttccaacaggataactgagcaggaatggtggtggagtggaaatgttgggcaatacaatcaggaagaacagtgagaagacatttctatcagtgagataccactggctgcagataatgaatattagattagattggtcaagattgaatgacctcaaagaattttactgttgccctcccacttttaaaactccagaacttcaacatgtatgctatatttaagaaattagataattaatatatggctaatggaaagagattaagcttgtagcagaatgttctctcaggacattccagtaagaaatacttcctagggaagttaaattatgagcaaatttgacttttttaaaattgtgtttgtagaagtgattatacccatatctccagtcctgctcaaatctctaagggactgatgaagaggttctgcattcaacaaagcctggaaaaacattttcctgcatttcccacttctttccatttatcagtggagatgagtcctgtcacgaataacttaattcaattctctatgcagagagaatgatagcaggacactgatttaatttttttaggccaaactgccttgcaggcaggtcctccagcattttctctggattcagtgtgagttgcaaaatgttatttgcagtccagttctcctggtagcctcgcaccaactcatttctcccagctttctaatttgtagttttcaagaataactgtaggatgtgctgggaatgcaacatcctgagataaaaggagattggagagaacaacctgggctcttttccagtcctctcagaaataggataatcttgaacaccttaacccagtgtttcacaggaccccagggtataaaacccatgctgggctgtttttgggggtccttcaactgcggtgcaagggaagcatgcacggatgaggctgcattgatcccaggaagctttcctgagccttgagggttcagcttgcaatgaatcacaggcttccattgccccttgctgtgtatctgtaagcgataaatccacttatttgtatgaataagttctgtcttgccagattcagacaagctggtaaccagtgcacagtgaacctgttttacatcaatgaattcccagttcccactgatctcaaatgacataaagatgattcttaaatataaacaaactttaaaaattgaatgcatgtgaatatctacttcaacgttaactttttggtggtttgagaaaatttcaagagtaaattttactcgtggtttgagaaaatttcaagagtaaattttactctatcagttttctataacatttttctatgtctctgactctatgttcatgtaaaaatttatatcctggttgattcaggaggggttcttctaatgactagctttgctgtcacttttttatgtgattttgatatctatccaagttttttatattggtctatctatatgccttgagactttcttcacatgaaattcttttgtaataatgttatgtgaatgatggtattacctctgaaaacaaatcagatattctaagttaagtctaggctcaacagtatatttgccttgagattgggggtacaaatatttatactttcttaatctgagttttctcatgtatattagatttctatgctgctattaaaatttaccaaaaacttaatggcttaaaatgacaacatgcatttattattttacagttctggagatcagaagtcctaaaatgaaggtatcagcaaggctatcttccttccaaagattcttagggggaatcagtttcctggcctttttcagcttttccaggtagcctactgtcctcagcttctaaaccgttctcccatcattccaacctccgcttccatcatcacatctccttctgtgactctggccttccaagcttcctatcacagtgacacctgtgataacattaggcccaaccagatcatctaagacaagctttccatctcaatatctgtaacttaaacaatccataaagtcctttttgttatgcaaggtaacagacacaggtttcaggaactaggacgtgggtatctttatatgtttatgtgtgggtgcggggggtgtcacatttttttgtccataacaacatcttctagaattggaaaactgatacctttcctacttatttctatggcttgccattacgctcaacggaaataatttatgagaaagctttatgcaactcgtgaaggtgtaatttactatagaagaactcgttctattgatcccacttcatgttttttcatttactacataaagtattttccctttatatttggatcattatatgaaccaattccaattctgtgattcatacaacttcttgtagtacagtgtgttttaccataaaattgtgacttcttctatttccggaaaaccgtattaagaacatattaataaaggatacatataaagtcacaatgtaaaatgcagtattgctgcagattattttaacacagaaaatgttgatgcagcaactgaaattaggaaagaagaaaaggaaaagattgtcatttttgccagagttactctagccatcagccagctccacaatattattttctttatttttccaaactgcataagcaaacaatgcaatgaaaatatatggacaccctttagtatatattagcattgttacttctttgtgtagtagccttataatcaatttatactcatatatatatgtatataaatcaattatatacaaaaaagtttgaaattacatagataactaatttcaagagaaaagatgtttgcctgtttgattcacatgtacacttatctaattgtgtgatagataatcaagaccatctggttacatagcaatgtatctctttcaagttgtttgtgtttgagttcaaagaaacacaaagggagtgtaatattttcattggttgccttcacattataaaattaattacaatgtctgccagctacctgcatatggatgatcatcttttgcttgtcagtaatttaaagcaaaattaatggtccataaaataggtgactagtttagctcataactcatacagaaatttttcatttagacaaccattatattatgaaataaataaagtgagcctattactctaagaatagcaactggcagtatttggtgtcaattataaaatgtaagtttataaatgaaaaattaaatttttaaaaatcttatgcctaccaccatgggcttcaacattgcccagttcttacagaatatttgtatgctatagctggtgaaattgattaatgtgacctttgtaattgcaagtttcagcatatgtatttgcaaaactcagggaaacaaagttttccaaatagtggttatatgatgctatacaattatgcataaattttaaaaatccactcaaaatgaaaaatagaccaataaacttttctatgtatatgcttcaaaaaattatctatggacattgacactttgatttctcatatttaggtgtcacaaacattacttttctttttaaagttgcaaagagtacagacaattcccatataccccacacccagatccctctattattaacatcataaattattttggtatggttgttacaagtaataaacaaatattgtacaccactagtaaagtacaaacaacacttctacagtttttaatgcccttttctgttcaatattctctctagagtaccatattaaatttatttgtcaagtatttgtagactcctctagattctgatgacttctcagactggtctcaacaggcttttaagaacaccgactagccattttatagactgctcttcaattttagtatgctggatttgtttctgaggattagaaaatgattatggttttttgggtttttttaatttgtttttcaggtggtgggtagaaagaagaaaaccacagagataaattgccattttcatcaaatcatatgaagggtatattttatcgatataacttaccactgttggtgttaactataatcatctgactgagatagtgtttatcagttttctctgtagtaaaattactcttccctttccctttccaaaagtactcttaagaaaaaaatactatgtatagctcaaatccttggggtagtatctacacaaattattctgaattgttctgcgtggaagatttgtctattgtgatcatctatttatctatttgctcattatttatgtcagtatggactcatgtatgtattttaatatttgatgttgtaatataatactttattatttattttgttgctcaaattgtttcaagcttggacattgggagctcttttaaattggtttctttcaccctttgatacaccctcactatggtatgcatgtgtgtacatgtgtgcactttcttgttggagctgcaagatgattccagctcatcaaccatatcccctgtcaagctgtagaatcaactatttccgcaaggattcttgctttctttattagagaatcgtattcaaaatcaaaatattacatgcggagtgacaagtggattttaattttccagagcataataatttattggcatggtttcagattagacatgaaaaatcctctttaagaaagtactatgtgacattagccaaaatggtgggataagaaactctaaatttaggctcttcctgaaaggagtgcaaaacaaacaataacaaaaactagcagaaactatgagaaccaattttgcaggaatttataaaacactcatagcaaagaaaagtccaagaccatatggcttcactggtaaattctgccaaacatttgaagaattaacactaatcattttccaagtcttccaaaaatagaagagagaaaacatttcctaactaattcttatgtggccagcattactttcataccaaattctgagtaagatatcagaagaaaaaaaaattacaaaccaaattttgcatcgtgaataatgataagaacactcagcactctagaaatagaagggaacttcctcaaaacattaaaggctgtgtataaaaacagaaacaaaaacaaaaacaaaaaccccacaaccactatcacattcactggtgaagtattgaaacctttcccctttaaataaagaacaagaaaatgatgcccacttccatcactgctatttaacattttaacggataaactgtctacagcaattagaagagagaaaagacttaaaggacattcaaattcgaaaggaagaagtacaactatctttccagatgacattaagcaatatatgtagaaaataataaagaacacacacacaattgataattaatttattattaataatttgttatttaataatagtaaacgaattaacagtccaggatacaagatcaatgcacaaaaaatgagttgttttcctttaaattaccagcaaatacccccaaaagaaaatgaataagcaggccgggtgcggtggctcacgcctgtaatcccagcactttggggggcccaggtggatggatcacctaaggtcaggagttcaagaccagcctgcctaacatggtgaaactctgtctctactagaaatacaaaaattagcctggcatggtggcacacacctgtaatcctagctacctgggagtctgaggcaggagaatcacttgaacctgggatcgggaggttgcagtgagctaagatcacactactgcactccagcctgggcgacggggcaagactccatcaaaagaaaaaaaaaaaaaaaaagaaacaattttatttacagtaggttccaatagaatcttatacttagaaataagttggtccaaaaaggtaaaatctgtgcaataaatacaagaaagcattgcttaaggaagaccttaataaatggaaataaatccagtgttccggataggaagacattactatttacatatcaatacttcctaaggaatctgcagactgaaagcaatctctatcaaaatatcaatagccttttattttgaaaaaatggaaaagcctattcttaaattcataatgaattgcaagtggtcctgagtagcaaaaacaatctttaaaaaaataataaatttggaagacttatattttctgatttcaaaatgggtcaataacataaatgtaatatcaaaagcattggcaatgaaatttttaaaaacagataaatttgacttcaaaataaaaaatgtgtgcatcaaaatacattgtaaaaaaaaagtaaatcacaaacacaatgagaaaaaacatttgcaaatcacctatctgaatatgtgttatccagaatatataaataactcttgcaactgaacaacaaaaatacaaatagcccaactgaaaaatgggcaaagaacttgaatagacatctcttcaaagaaaatagagaaatagacaaaaaacataggagataattctcaatcccattggtctcactgggaaaacataaatttaatccacaatgaggtactacttcacatctactaagatggatataattctttttaaaatgaaatcggcaatggtgaaaatatatagaaatacataaaattgtttagccagtatagaaaacaatttggtggctacataaaaaattaattagaattaacaattaacccagtaattccacttctagatacatacccaaaaattaaaaacaggtactcaaatacttgtatacgtatgttcacagtttacagtgcgatattcacaatagccaaaagatagaaatgacacagctgtccatcagcagatgaatggaaaaacaaattgcaatatataatcttaatggaattttattcagccataaaaaataaatgaagtattaatagataatgcaatatgggtgaacctcaaaaacatcttgcttagtgaaggaagccagccagtaagatcacatattgtatgtgatctgagatatgacttatttgaaatatccagaataggtacatctttagagacagacagattgatgtttgccagcagctggggcagagattggaattcagggtaactgcttaatcaatgcagaattttctttggggtgatgaaaatgttttggtactatatagaggtgacagttacataacattgtatatgttctaaatgcttttgtgcacattaaaattatcaattttatgttatattaactttacctcaagaaaatcccactttacctccataaaataaccaagtgtaataataggcaaaacttttgaagacaatttatggaatatatatataatgaaatatatattatgaaatataaatatattttccattcatagatatatatgtgaatggaaaatgtgtacatggtaatatgtaatattattagttatcagataagtgcaaataaaaccacaataagatataattatgcacttggtagaatagctttaaaaattgacaatacttagtgtctacaagtggagcaactggaattctcatagatcctacaaagaaaaaaaacggcaccccactttagaaaacagtttggcaattttatagaaagttaaacactaagtggcatcacaattttagtctagtatttacacaagtgaaataaaaacttacattctcacaaaacctacctgtatttgaatggttccagttgatttttaaaataattactccaaactagaatcaaccgaaatgtttaaatggtgagctaataaacaaactacaatgtctttaaatgaggcaataatactcaaaaaggaaaaaaaaaaactcatacgtgcaagaatctcaaatttattatgttaagtgaaagtagacaatctgagagtctagtaagattatatttctatgacatcatggaaaaggtaagagtatagagatagaaaacatagcagtggctaacaaagattgagagtgtgagggaggagttgtctacaacagacatgcaggaatttgggggttagaaccactttaaattttcattatggtgatggttacactactatatacatatatctgtactcacagaactacattaaaagtgaattttctttgtatgtaaattgtacttttaaaaagctcatttagaaatttgaaaatctttcatttaatatacatacttaccaattgttcagaatctccccatcaacaccccaaatctggattccatttcctttactgttctacaaatcctacatcttgcttatcaaattgattcactgagtggcatctctcaagcatttctgtctatttcaagggtgacttgagtttattgcagtcattgtcaggacttctcactcatacgagtgtcaatattcagcaactattgaacaactaataagagccatgtgaagtgatataaagatttaaaaaaaagtatagtcacacatccctccaaatggttcagtcttctgtttgaaggcatacaagtagccaggtaatttccatgcagtcagtgataccactgatgttcaagttgtgaccaggtgctccaggaatgtaaaaaataaaaaggtgggataaggcacgcaatccacattagatgtggtagaaagggtgagttctgaatgatatattaaggaacatatactttacatcactagaatagatttgctattgtctataatcctaatgcctatgttaaatatacttatatgtggctcctgcaaattcgaaaagcaaggtgcctgtgtgcttcctaatctggagacgttctcagacagccgccttagcgaacaaggtgattggtcttctttgtgattttgcagttagcttttgataaccttccagtttatttcattaatgtaaacacttccgagactagtacatcttcttaaataaatacttgtcactcatcgacatatgaaaacttatattcactaacttgcatcgctttttatttctgtcttgatcacttagagattccttatcatgtacaccacatgcttctgttggaatgagttggtctggtatgggaaatgagtttctaacagatgaggttttgaacaattttgctgccacttcattttctcaaatttatttacatgatatatgttttttgttttctttagataaatatcttatttgtttaaccatcatttttgacattgtgctgtgttctagaccagggtaaaaagtcaaagaaagcatagtttccatgtgtgcctttaactgtggtattgaatttgatcttttagttcactgaataaataatgaagtaaccaaaagagagaatacagaaagagaagtcattgaatattaaagttattcttatatatataaagattatgaattatcatttttgtgagctatttaaatagagctattcagagtaatgctagacagagataatttatagagctgtaagggagaagaaaacaagacttaggaaaaaacatgatgttggtaaagaaaaaggagtaaaatggaggcaaaaaaaggaatagtaatagaaatggaggctgagtaaggacagggctcataataaagttcaaccctactgaacaaaggtcaagtgaacaatgatttcaagaatgtgaactgttactactaataataacacagaaaaagaaaatgtaacaagaattttaaatgagccatgggcattgacaactagtccttgttgaccttagcaggaagaatttcaatagagtatttgcatcaaattgttagaatgagtgaaatgtcaaaacattaagcctaagctacatttgtcaaagatgtatatactccatgaatatgtaaaattacataaagaaccacaccaagatgtaattacttgatttataagaacattaatcaacataaaaaatcataaagtttcctttaaacaagcagatgtgaaatcatggtaaaaagagaggtccagtgttttttagttatttcattgaaaacaatgccattcctgctttttaaagctcctcccttttccccatggaggtacagagcctgaaaactcaattttcccaactcacctaccaggagaattttcatcagattccaccaatgaatggccaaatgtagaccaggatgatggaaaagacagaagccattattcttccatggcagctttgggaagtcctgtggaaaacagcagacatcagacattatgatttatctgcagcttttgcatggtgtcctgagaataactaacattggtattgttggcagcggatgtcatcagtggtggcttataatagttctgaactttctcccagaaaatacccaagtgggtgctagagaactttgagtccattcctgcaattccagattctctgtcctgtattactctagcttccaactgtttaagcttcaattttcctattttaagctacttccttctcaaaacacctgaagaagcttttgttttcctgaataaacaccaagtgataaaatatgtataaaatgatattgctatttttagtgaataaaaatgctccaaatttcaagaatacatttattacttaggtaaggcaaaagagtgtttacttgtagtaatcaaattactagaaaattgttagatttttttcttccacaatgactgtgtccttcaatgaattttcccccatagaaataaagaaaatacaggtgaactgaaagcgttttcaattttgctttcatgagaaactccctttttaatttccaaatttgtattttcacagtctggattttcttgcaattgcccagatacacttaacagcagcttgctcttttcattataattaatgtcttccatgagttgagactagaaaaaaaaaacctgtaaaatcttattgatgaacatatctaaaaatcggttcattaaaattcaatgagtctttgttgactaatgcctaataaagtagacattaatttagaaaaaccaaagaatctgtaattttttacttttttgaactccaaagataagttatttaatagttattacatactttccttttaaaagaatatttaaaataatgtggcaattaattgattatatttggaattcaattactactactaaatgtatggatacctagtgtgaaataatcgttagtgaattgaaatatgttacactttcactttcctaaagtccttcatcattggccattatcctcaactctcaaaaaaccatttctggcagtgaatactttattatatcactatttaattactttggatatgatttcctggagaattattattgattttgttttctggcataattgtttcttaataatatatattatgatggctggtagctgactttataaaatctttgggtatttactacaattgaaacctattggaatattaaatattctaatggatgaaattttattttctttagtaacagatgagaatgatgatgtagtctgttagattctaaaagcagaggactatattgtgttcccttttgtatatttaatgaaaaaatagtgaattctaagaagttccttattaaatgttgtcatacgaatggataactgattttcaaacattttagccaattacagaaatggtaaaaatatttatcttctcttttaattatattttctagattaaataatttggcctatgttatacaaattaatagattatctactgctacctcctgatttgctattactaatgctgagcaatatccacagcctccttaagaatacatattagaattgaagaaaatcctaaaagtctccccaataaatatgggtaaaaagcattaaccctcatattaaatagggaaacttagcttgttctctcttccagaaatacaactgagagaagaaatgtaaagtgggaaaagcagagtcttctatttagaatgtaagctgtaaggtctccatgtatgtctgtgtgtttatctatatatgtatgtatgtattttatgcatatgtgatatttatctaactgtagatggcattaaaaaactaacttataaaaaactttaaaaagttctattcaaattggtttagagataaataagtgcttatataaattaaatatttcaaacactcccagaaacatagaaagtaacccatatacttttttagttcatgtattttgagtaaatctttaaagactaatttaatattgttggtttaataaaaacagccatgttttccaagatattggcattagtacagtatgagcatacatcgtcgttctacttggttttacaagccaaaattataaattcatcctaagaaaaaatatacaagtaaaggtgcagtaaaaatgaatttcttttttttttttttttttattatactctaagttttagggtacatgtgcacattgtgcaggttagttacatatgtatacatgtgccatgctggtgcgctgcacccaccaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtaaaaatgaatttcttgaagtccattactttatgcatgttaaacatatagtaaaacaattggaaaaacctatgcatttaactttttgtagtttgtgtgtgttttatacttgtctcacatgcatgcatgtgctataaaaacagtcaacaggtaagaaactggagatggtggctagctttgattaacattatacatctgtctaaaaaaagttccaggtaatctctgagtaagataaactatggaaaccttaattaccaaacgtaagattcagtttatattcttttgacttcttatttttatacggtataagggtattaaagatatttagttctggtaataaacgtgtactttttgacatatcgaaaaattatactgcgagaaaattcataccaataaaattgtcatatagtataattgtaaagtttgctagttatctacagaattctggtaagcaacagacaacttacaaatgtctactgcctaactttctctgttaaggaaagattaccaatggttaaaattataatcaacatatgaaaataaaactactaaatatataagggcaacaacttagtataaaaagtatgaaaggaatataaaggtagttttgataagaaaaagtatataaggtattaaaaatgtgtttaggacaataattcgtcctaaactaaaacaatcggttgttccagaatgagaagaaagaaaaatacaggacaaaaactgaatatatatggaaagttagagaaggtttgtgaaaaaaaattatttggccaaattggcaaagattgaactcatttatttacaacatttaaaaaaaattatgtttattatcaaaagtagattgatgcaaaacaaaaatttgtcttttttctgttaaaattatagctttattggattactgttccgattacagtattatcttaataaaatgagagactgaaaggttttatttaccatttaattaatctgcataggaaaccaagatttctgttctatcagatgaatttcctgtgctttatgttaaccttcatcatgttcttaattaagagcatgcagactgcagttttcaaaaactaattttttaacatattttttacaattttgtccttccaaaatcaaatcctaaataaaagattgttgttcttgaactgacattgagattcccaagaggacgctgaataacctcaaacaatttattcttttgttgtgtaaaagagagatgttacaaataatttggtttatttgatatgttaaattgcatgaaaagtgttgtcaaataaaaaagatattcagcctactctacatgatatttgtctgggcaaatattattaatacagttatttcagaaattgtacaaagttcatagaaatttgttaatgctatacctagccatgacacatcatagtgacagcgtgctggcagtcctcacagccctcacttgctcttggcgcctcctctgcctgggctcccactttggcggcacttgaggagcccttcagcccaccgctgcactgtgggagcccctttatgggctggccaaggccagagccggagccggctccctcagcttgcagggaggtgtggagcgagaggcgcgagcgggaaccgcggctgcgcgcggcgcttgcgggccagctggagttccgggtgggcgtgggcttggcgggccccgcactcggagcagcaggccggccctgccagccccaggaaatgaggggcttagcacccgggccggcagctgcggagggtgtactgggtccgccagcagtgctggcccaccggcgctgcggtcgatttctcgccaggcctcagctgccttctcgcggggcagggctccggacctgcagcccgccatgcctgagcctccccgctccgcctctgcgggctcctgtgcggccccagcctccgcgacgagcgccgccccctgctccacggcggcgcccagtcccatggaccacccaagggctgaggagtgcaggcgcatggctcgggactggcaggcaactccacctgcaaccccggtgcgggatccactgggtgaagccagctgggctcctgagtctggtggggacgtggagaacctttatgtctagctaaaggattgtaaatacaccaatcggcactctgtatctagctcaaggtttgtaaacacaccaatcagcaccctgtgtctagctcagggtttgtgaatgcaccaatggacgctgtatctagctactctggtggggacttggagaacctttgtgtccacactctgtatctagctaatctggtgggcacgtggagaacctttgtgtctagctcagggattgtaaatgcaccaatcagtgccctgtcaaaacagaccactgggctctaccaatcagcaggatgtgggtggggcaagataagagaataaaagcaggctgcctagctagcagtggcaaccctctagggtgcccttccacactgtggaaggtttgttcttttactttttgcaataaatcttgctgctgctcactctttgggtccacactgcctttatgagctgtagcactcactgcgaaggtctgcagcttcactcctgaagccagcgagaccaccagcccaccgggaggaacaaacaactgcagacgcaccaccttaagagctgtaacactcaccgccaagccaaggtctgcagcttcactcctgagccagcgagaccacgaacccaccagaaggaagaaactccgaacacatccgaacatcagtgggaacaaactccggacacgccgcctttaagaactgtaacactcaccgcgagggtccgcagcttcattcttgaggtcagtgagaccaagaacccaccaattccggacacaatagtataatgttaccactaataatttcaattgttatgccacaaaaataactggaaatataacctgtgatgtcataaaccaaatattttgttaaattctcatcagatctttaaccatggcgatttaaagctatttgtcatcaagaaataattttaattttattctgatttttccctaaaagttcttgtaattaactactagccaaagtgcttcatttttaacaaaatgtgactgtctcagaaaccacagacagaactatgacagttaatctggaatacaggcttctgatggcattgctgaaataactctgagaacacaccactagactgtacagacttctagaactacaatagagaaactaatcagttcatcaagtagttaacccaagataaagcagaacaagaactagttacatgggactgaatgaactgatgaaaaatgattgtgatttttatgcttccttggtatatagctggttctttaaagatctaggttctaaatatataatagaccccatttgctatatttatgaataccagataattatgtattttagacttactacatctccttagccagcaaagcttgaaggaattgtgagagttaattcagtttgtccattgggaatcctgtggacttgcatctagaattcaaatttgaatttcagttttgaatgtcatcacttacctaaaggactgctgaactggaaatatgtaaacattctgtttcagaatagtgatatgataagtgtttactccaaagattttaaaagttatgtttcactacaatctttattcccttttcatattttcttttaactctatttgattaaggaaacaccacagtgctatttgaagtctctaattgtataagaagttgatagaaatgctcagtcagtatgtcatcgtcgcagagatatattttaagcctctaagaggccagcaaataccagatactctcattttgtacgtaattttcagtttctgcaagactctggcccatttatgcaaaaaacttccttattaggataactacaaagaaacgaaatatctgtgtatctaatttacaaaaatagagcaggtaaaactagttaaatattatcacatatgaatttgaatcttattataatgtttatttgccatatattgtcagtgagatcatgtttcattaacttggtgccacttttctacctctaatgtctctgaaatcttcatatagagatagcaatgtaaaaatcaaattggaagtgttattctttcttagtcttacataatagtgcatttaaaacccaatgacatcttagagtcagtgaagtctgctattattctgagacttttcaggagcaattgctaaaatattaataacaataatttttaaaacctcactgggtttgggagatgaggcttctttttccagccatgatgggttcatatggaatttatttatccttctgcttggaacagttaaacacagaacaaagtatgtgagacaagtgtttgtaaacattggacagtaaatagcacaaggcagttatctcttaggtaaagtatcacttaagccgtagagttgtcccattttactgcctggagagagttcataggacacagcatagggagagtgaacccaaacatattcctgcaggctcctcaattgaggatacagagttgagaattttgggagaacaaagtagctggaatgcacaagccagagaactgaaaaacagaaaagaaaggcatgaacaagaggaagatacagagagagagctccagagattacttacctattcttcagctgattggtaatccacacatatgtattcactgagatgcctggttggcaatgttggccattggagtccaaggaggccaatttacctttgcctgtaaagggtgaagactaatccccaagtttcaaagctaggaagattggtcacagtggactagggagctggtcaataaaagatttagtggcagggaaaagctataaggtcattgataggatattggtcttgggaaaaggagattctgaactggtatcgtgtgcttaatttaaaaaaaaagttgtatgttaatgtagttaaaactatttgggacacaatgtttgactcttagaagatagatacaataccacatgatatagtagcctggtaacaatgagaagcagtggggggctgtgggttaaggaaaatgtctagacctccacaactggtttcagggaccttctggtaattggggcagaaggtgtggtcagtgatactagatgaatggataaaagcctccagaaataagtgaaaatgttttaactagttagcactttgatttgttcaagtgcatcatcacagttatgggtatactcctagatttgagtgatgttatattagataatttctttggcagaccttatgagagtaagaattgagactttttataggaataattaggtttttcttaaactttgattttaagtttggggtactagtgcaggatatgcagttttattacataagtaaacacatgtcataggggtttgttgtacagattattttatcacccaggtattaagccagcctagtacccattagttatttttgctgatcctctccctcctcccactctccatcctccagtaggccccagtgtctgttgcttccctgtatgtatccatgagttctcatcatttagctcccacttataagtgagaacaggtggtacttggttttctattcctgcattaatttgctaaggacaatggcctccagctccagccatgttcctgcaaaggacatgatctcattctttttcatggctgcatagtattctatggtgtacatgtaccatattttctttatcaagtctgtcactgatggtcatgtgggttcatttcatgtctttgcctttgtgaatagtgccgcaataaacataagtgtgcatgtgtttttaaaatagaacaatttatgttcctttgggtatatacccaataatgggatagatgggtcaaatgctatttctgcctcttggtctttaaggaatgttcacactgtcttccacaatgattgaacttatttacctcccaccaacagtgtataagtgctcctttttctccacaacctcaccagcatctgttattttttgactttttagtaatagccattctgactggtgtgagaatcattgtggttttgatttgcatttctctaatgatcagtgattatgagctctttttcatatgcttgttggctgcatgtatggcttctttggataagtgtctgttccttctgttcctgtcctttgcccactttttaatggggttgtttttctttttcttgtaaatttgtttaagttccttacagatgctggatattaaacctttgtcagatgcatagtttgtaaaaattttctaccgttctgcaagttgtctgtttactctgttgatagtatcttttgttgtaaagaagctctgtggtttaattagatatcatttttcaatttttcttttgttcccagttgcttttggcattttcattatgaaatctttccccatgcctatgtcgtgaacggtattgcctagattgtcttccagggtttttatagttttgagattttacatttaagtctttaatccatcttgagttaatttttgtatatggtgtaagtagggggtccagtttcaattttctacatatggctagcggtaccacagcatggcacagctcttctaagaaagcatggccagactgcttccttaagcaggtcctcaatctgttcctcctcaccgagtagaacttccaactggagcctccagccacttcttggatgttctctggctaagaagcgtttgaaaacttcatggtacagagctcccagagggagaggcaggctccacctttgctgtttcagcagcttagccattctagcctccaggttttggagcgctcaagccaactgaaggcagaagtgctaccccagcagagcccagctgctctacagcatggctagagtgcttttttttttaattttattttttatttatttatttttttgagacggagtctcactctgtcgcccaggctggcgtgcagtggcgcgatgtccgctcactgcaatctccacctcccgggttcacgccattctcctgcctcagcctccggagtagctgggactacaggcacccgccaccatgcccgactaatttttttgtatttttagtagagacggagtttcaccgtgttagccaggatggtcttgatctcctttgcttgtgatccgcccacctcggggtcccaaagtgctgggatttacaagcgtgagcccccgtgcccggccagactgctatatatatatatatatattttttttatactttaagttctaaggtacatgtgcacaatgtacaggtttgttacatatgtatacatgtgccatgttggtgtgctgcacccattaactcgtcatttacattaggtatatctcctaatgttttccctccccccttcccccaccccacaacaggcctctgtgtgtgatgttccccaccctgtgtccaagtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataatattccatggtgtatatgtgccacattttcttaatccagtctatcattgttggacatttgggttggttccaggtctttgctattttgagtagtgccacaataaacatacatgtgcatgtgtctttatagcagcatgatttctaatcgtttgggtatatacccagtaatgggatggctgggtcaaatggtatttctagttctagatccctgaggaatcgccacactgtcttccacaatggttgacctagtttacagtcccaccaacagtgtaaaagtgttcctatttctccacatcctctccagcatctgttgtttcctgactttttaatgatcgccattctaaccggtgtgaggtgatatctcattgtggttttgatttgcatttctctgatggccagtgatgatgagcattttttcatgcgtctgttggctgcataaatgtcttcttttgagaagtgtttgtacatatccttcgcccactctttgatggtgttgtttgtttttttcttgtaaatttgtttgagctctttgtagattctggatattagccctttgtcagataagtagattgcaaaatttttctcccattctgtaggttgcctgtttactctgatggtagtttcttttgctgtgcagaagctctttagtttaattagatcccatttgtcaattttggcttttgttgccattgcttttggtgttttagacataaaccactgctcaatgaaataaaagaggacacaaacaaatgtatgaacattccatgctcatggataggaagaatcaatattgtaaaaatggccagactgctttttttaaaaggacccccaatcccgttcctcctaagcgagacctctcaaccagggcccctagccagctctgacaagtgagttcgggctggccacaggtctgtaccccactgtgatggagctcccagaggaaggataaggctgacatctttgttgttttgcagccttctctggggatacctccaggtagtggaaaatcagagacaactagggactagagtggacactcagtgaactgcagcagccctaaagaaaagtggccagacttacaagaaaaaaaaaacaaaaacaaaactccatccgaaggtcagaaacttcaaagattgaaggagggtaagcccacaaagatgagaaaggatcagcacaagaacacggaaaactcaaaaagtcagagtgccccctctttcctccaaatgactgcatcacctctccagcaagggtttagaactgggctcaggctgagatgtctgaaatgacaaaagtggacttcagaatatggataaaaacgatcttcactcagctaaaagagcacattgtaactcaatgcatggaagctaaaaatcatcatgaaacattgcaggagctgacagacaaaatagccagtacagagaagaacataactgacctgataaacctgaaaaacgcaatacattaatttcataatgcaatcacaaacgcaagtattaatagcagaatagatcaagtagaaagaatctcagaacttgaagattgtctttctgaaataagacaggcagagaagaatagagaaaaaagaaagaaagggataaacaaaacccccgatagatgtgggattatgtagagactgaatctatggttgatatacctgaaagagatggggaaaatggaacgaatttggaaaacatatttcaggatataatccatgaaaacgtcccaaacctggaggccaacaataatttttattgagatttcggtgtgtattactagctaaatccatatttcttacttagctcttcctgttgaagcattgtgttagcttttcattatcatgcaagagttcaaacagttaagaaaatcaaagtggattttgagggataggatttaattttacacaaataggttagagttaccagataaaattaagagtgcatttattactttacattttgataatgaggcagaaccctggaaaagggaatttgctacattgcataattcctaagataaattattcacttcagctgacccattatctttattttcttgtgacagatgtcttttaaaaaatgttcacaatcttatatttcctcagctaaaattcatgctacaatgtagatatatgctttcatttttcaaaaatagcattactaaggaaaatttactaaaaatattaccatataattcaccctttaagtgttcagtgattcatatttaatgattttttagcaaatttgtagagaagtgcaaccatcaccaccttctcattttaaagcattcatattaccacaggtacttccttgagtcatttgcaatcaatacccattaccacactctgtcccaaacccttattcatcaatatactctttctataaattttcctcttctgcaaacttcatggaagtgaaaatatacaatagttttatttttgtatttagcattttcacttaacataatgttatttaagattcactgaccttatacattgaatcagtagttttgtcttttttattattgaataatattccatagtattgatatattttgttcctctattaccaactgttgtatatttgaattgtttccgcctttggaatattataaataatgcttttatgagcatttgtatgcaattatttttatgaagatgttatcatttcttttggatagatccctaccagtacaacagttgagtaatatgagaagtttgcatttaagtttttaagaaaataccctcccacctgtaatctcatcactttgggaggctgaggcgggaagatcacttgaggtcaggagtttgagaccagcctgggcaagatggctaaaccctatctctactgaaaatacaaaaaaagaaaaaaaggtagctgagcatggtggcacacacctgtaattccagctactgtggaagctgagacaggagaattgcttgaacctgggaggtggaggttgcagtgagctgagatggtgccactgaactccagcctgggcaacagagtgagactctacctcaaaaattaaaaaaggaaaatgtcaaagagttttacccaagtggctataccattttaaattccatatcaaagtaggaggggctctagtttttctctataataaccaatacttggtattgtctatcttttttattacagtcattccagaggtgtatagttctgtgtcactgattttttagtttatagttctctaatgactaatgatttatctttgcccttccaccatgtaatgtttcctgccatgttatgatgcagcaagaaggccctcacaagataccaggaccctggtcttgaacttctcagcctccatagctgtcagctattaaatttctcttcattataaatttacccagcctcagatatttttaataacagcacaaacagactaaaacacatggatatttattttatgatttaatttgtaattcaatacaatttaatgtattttttcgtcaaattaatccaggtttggtcattagcatattttttacttagcttcgttgtatctttgatatattcccattcatttttttttcaatccttcttacttttggtaactatgagatatttcagactcatcttgtttatttcctggcccagtcctaaaatcagacatttatccatagagccctggctaactttattggagaatagtattagaaaccaaaaccagggcaccagagatgcccagatctctacatatttctatataaaccatctgtatctatattaagctaagcattagtttatactgatgtctctaacttgaattcactaacacatgaatcattttagacttgtcttgttatttgtatcttttcactccagcagaaacatgaggctcccccaactttcaacatccatttatttaattgttcaattccagtatacatgtatagcagtctcagacttgttaacctatgtgcccataggaagcaaatttaccaactggactgtagcatttacatgcatttccttttgcatttaatctacatacacattcccagagttaggtatgtctacatcatttaccctagccccttcagagagaatgtttctcatcttagtgatatagttagattctttggtcacaaacattatttattcctaatatgcctcaacctcataaatatatactttttgttacatacattaaggttcagtctttgtgctgtaaagttcaattggttttaacacatgcttcatgttatgaatccactgttacagtatcacactgaatacatacatacatgcagaatagttttccttccctaaaaaccctcagtcccgcacttcatctactcaaccctaccatcctttccctaaacccttgacaagcacttatctctttactattcttatattttgtctgtaccagaatattatataatgggaatcatccagtatgcagttttttcaggttaatttgtttcattaggtaatattcacttaaaattcatgttttttttgtggtggcttgatagctcatttatttttattgtgtataatatctcattgtatgggtgtaccacaatttgtttatttgttcactcattggaggttatactggctgcttccagttcttggcaattctgaataaagcttctacaaatattgacatgcaggatgctgtgtggacataagttttcaaatcagttaggtaaatacctaggtgcataattgctcagttctatggtaaggctatggttggctttaaaaggaactgtcaaactgtcttccaaagtggctgtattattttgcattcccaccagcaggaatgcaagttattgttgtgccatatcttcaccaagacttagtcagctttttttaaaaaaaataaagtgctataaataaaataaaactttacatatctaataaaatttttctagtgatatctggctttaacacatgcttcatgttatgctgtttatatttgcaattccctaatactaaatgatcttgagcatcttttcataggcttattttctacctacatattttctttagtgaggtatctgttcagatcttctgtcctcttattaatttaatttttcattttcttattggtaaattgtaagtcttatttttctattttagatttgtctttattagatatgtgtttttgcaaatttttttctaatctatttcttgttttctcattttcttaacaaaaaatttagagtgaacatttttaattttaatgagtgccaatttatttttttcataaattatgttttttaatgttaaatctaaaatgttattgccaatattaaaattattttctgaacataatttgaatgagattgtagcataaacctattcataaataaactaagcattatattgttttagagtttataaagcaaactgaaacaatacaaattaaaatttgaatctcatctaaagtcaaaatacattattacggaaaatccatgtgaaataattcttaatattttgaataccagatacaatttctaaaaactaatgttaaagcaaagtatgttgtcagaggatcttgttctgaaaaatgaagcaatatagacctggcaatattagatagacaaaatgtaataatgggcttcattctttccttacattattgtttttagggaatctcatccagggctatgtctttaaatagtatttgtagactggtgatccctaagttacaaaccagtgttgaattctttttgaactccaaattcttccagacaccatggtatttacattgtaatttttccttttatgtatttattttgttattatgctttaagttctagggttcatgtgcagaacatgaaggattgtcacataggtatatatgtgccatgttggtttgctgcacccatcaactcatcatttacattaggtatttctcctaatgttatccctcccccagccacccaccccctgacaggccccagtgtgtgatgttcccctccctgtgcccatgtgttctcattgttcaactcccatctatgagtgagaacatgcggtgtttggttttctatccttgtgatagtttgcttagaatgatggtttccagcctcatccatgtccctgcaaaggacatgaactcatccttttttatggctgcatagcattccatggtacatatgtgccacaatttcttaatccagtctatcattgatggatatttgagttggttccaagcctttgctattgtgaatagtgccccacaataaacatacgtgtgcatgtgcctttatagtagcatgatttataatcctttgggtatatacccggtattggggtcactgagtcaaatggtatttccagttctagacccttgaggaatcgccacactgtcttccacaatggttgaactagtttacactcccaccaacagtgtaaaagcattcctatttctccacatcctctccagaatttgttgttttctgacattttaatgatggccattctaactggcgtgagatggtatttcattgtggttttgatttgcatttctctgatgaccagtgatgatgagcattttttcatatgcctgttgcctgcataaatgtcttcttttgaaaagtgtctgttcatatcctttgcccactttttgatggggttgtttgattttttcttgtaaatttgtttaagttctttgtaaattctggatattagccctttgtcagatgggtagattgcaaaattttttcccattttgtaggttgcgtgttcactctgatgagagtttttttttctttctctctctctctgcagaagctctttagtttaattagatcccatttgtcaattctggcttttgttgccattgcttttggtgttttagtcatgaagtctttgcccatgcctatgtcctgagtggtattgcctaggttttattctagggtttgtatggtttttggtcttacatttaagtctttaatccatcttgagttaatttttgtataaggtgtaatgaaggaatccagtttcagctttctacatatggctggccagttttccccaacaccacttattaaatagggaatcctttccccattgcttgtttttgtcaggtttgtcaaagatcagatggttgtagatgtgtggtgttatttctgaggcctctgttctgttccattggtctatatatctgttttggtaccagtaccatgctgtttggttactgtagccttgtagtatagtttgaagtcaggtagtgtgatgcctccagctttgttctttttgcttaggattatcttggttatgtgggctcttttttggttccatatgaactttagttttttcaaattctgtgaagaaagtcagtggtagcttgatggagatagcaatgaatctataaattaccttgggaagtatggccattttaacaatattgattcttcctgtccatgagcatggaatgttcttccatttgtttgtgtcctcttttatttcgttgagcagtggtttgtagttctccttgaagaggtccttcacatcccttgtaagatggattcctaggtattttactctctttgtagtaattgtgaaagggagttcactcatgatttggctctctttgtctgttattgatgtacagaaattcttgtgacttttgcacattgattttgtatcctgagactttgctgaagttgcttatcagcttgagattttgggctgagatgatggggttttctaaatacacaatcatgtcatatgcaaacagagacaatttgacttcctcttttcctaattgaatactctttatttctttctcttgcctgagtgcactggctagaacttccaactaaagatgttctttgaaaccaatgagaacaaagacacaacataccagaatctctaggacacatttaaagcagtgtgtagagggaaatttatagcactaaatgcccacaagagaaagcacgaaagatctaaaatcgacaccctaacatcacaattaaaagaactagatgttgaataggagtcacgagagagggcatccttgtttcttgccagttttcaaagggaatgcttccagtttttgcccattcagtgtgatactggctgtgggtttttctcataaatagctcttgttattttgagatatgttccatcaatacctagtttattgagagtttttagcatgaagcgctgttgaattttgtcaaatgccttttctgccactattgagataatcatatggtttttgtcattggttctgtttatgtgatgtgttacatttattgatttgcatatgttgaaccagccttgcatcccagggatgaagccaacctcatcatgatggataatctttttgatgcgctgctggattcagtttgccagtgttttactgaggattttcacattgatgttcatcagggatattggcctaaaattctctttttatgttgtgtctctgctaggctttggttttaggatgatactggtctcataaaatgagttagggaggattccctctttttctattgattggaatagtttcagaaggaatggcatcagctcctctttgtacctcttgtagaattcagttgtgaatccatctggtcctggcctttttttggttggtaggctattaactattgcctcaatttcagagcctgttattggtctattcagagattccacttcttcctggtttagtcttgggagggtggatgtgtccaggaatttatccatttcttatagatattctggtttattggcatagagtagtttataaaattctctgatagtagtttgtatttctgtgggatcagtggtgatatcccctttatcattttttattgcatctatttgattcttccctcttttcttctttattagtcttcctagcagtctattttgtttatctttttgaaaaactacctcctggattcattgattttttgaagggttttttgtgtatctatctccttccgttctgctctgatcttagttatttcttgccttctgctagcttttgaattttttgctcttgcttctatagttcttttaattgtgatgttagggtgtcgattttaaatctttcatgctttctcttgtgggcatttagtgctataaatttccctccacacatggctttaaatgtatcccagagattctggtacattgtgtctttgttttcattgttttcaaagaacatctttatttctgccttgatttcgttatttgcccagtagtcattcaggagcaggttgttcagtttccatgtagttatgtgattttgagtgagtttcttaatcctgagttctaatttgattgcactgtgctctgagagacagtttgctgtgaattctgttcctttacatttgttgagaagggttttccttccaattatgtggtcaattttagaataagtgcaatgtggtgctgagaagaatgtatattctgttgatttggggtggagagtactgtagatgtcttttaggtccgcttggtccagagctgagttcaagtcctggaaatccttgttaaccttctgtctcattaatctgtctaatgttgacagtggggtgttaaaatctcccattattattatgtgggaatctcagactctttgtaggtctctaaggacttgctttatgaatctgggtggtcctgtatttggtgcatatatatttaggatagttaggtcttattgttgaattgatccctttaccattatgtaatggccttctttgtctcttttgatctttattggtttaaagtctactttatcagagactaggattgcaactactgctttttttgctttccatttgcttggtagacttcctccatccctttattttgagcctatgtgtgtctctacacgtgagattgatctcctgaatgcagcacactgatgagtcttgactctttatcgaatttgccagtctgtggcttttaattggagcatttagcccatttacatttaaggttaatattgttatgtgtgaatttgatcctgtcattatgatgttagctggttattttgccccttaattgatgcagtttcttcatagtgttgatggtctttacaatttggcatgttcttgcagtggctggtactggttgttcctttccacatttagtgcttccttcaggagctcttgtgaggcaggcctagtggtgacaaaatctctcagcatttgcttgtctgtaaagaattttatttttccttcacttatgaagcttagtttggctggatatgaaattctgggttgaaaattcttttctttaagaatgttgaatattggcccccactctcttctggcttgtaggatttctgctgagagatctgctgttagtctgatgggcttccctttgtaggtaacctgacctttctctctggctgcccttaaaattttttccttcaattcaaacttggtgaatctgacaattatgtgtcttggggttgctcttctcaaggagtatctttgtggtgttctcagtattttctgaatttgaatgttggcctgtcttgctaggttgctacatggtaatttttctttgattatggttacataactaatatcacttcatacattttatcaagtggcactctcaggatttgccaaggctaacatctcctacataaaaatctgagacatgtaagagtcttttcaaaaaaaaaattctgtatttatgaccataagttaagttccaattctagctacaatgataaataagtcttttaatattctattagagatattccactagagatatttggtcagaatagtatttgaagaaataaatttttagcacctctctgagcaggtatttgggaaaggaagaaacagatggtcaaaaaaggactctggattgtggtgattcttatggtatttaattttttttctgtttttcagcactaaagaacttttcatagatccacctctacctttacattgacatttcttaatttttaggagatatatatatatatatatatatatatatatatatatccatatatatcaatgtacagaaatcatgaatgtgccacttgataatatttatgatgtgattttagttatataactatcactcaaagaaaaattatcagccacccagctcttaaggtctgtctcagacaatactccaaagtataagcacatttctgacttctagtcctatgaaaaaactttgtggaaatggaattatatagcatgtattctttcatctctcttttttcttcaacactatgcctgtgaaatcttctcattttattttatatcactgtagcttcttttgtaatggctgactaatgtttttgtgttttctactattgaaattaaatgaggtgttttgcaattgatattaactaatgtgctatgaatataatttcatatgtattttgttataaatatatacaaatttcctaaaatgtattccaagaaatggactcaatgacactcctgatatgcatatattcatttagcaaataataacaatttttaaagatgtatttaccagtttacactatcaccaatctccattttcattcttttaaaggcatgtgcatttgaacttgcattgctttaaaccacattatacagatagctaccaagttttgcttgttgatactaaagccctactagaacaattttaaaaattaacatttttaacatttttatattttttgttacttaaactcaatactggttcttaatttgttcttgttttgttttatatagtaagtaaatgaaatttagaaaatatattaattagctgttataataatgttattacaaagaaccacgaaatctcagagatgtataaaaatcagcacttactagatcacaagtctcaagttggtgggcaatttgctaatgtagggggagcctgaatgggtctctgctgatcttaactcggattggacttaggattctgctccaaggggactgtctttctcctactgggaccaatggactggcccagaatatacttttcataacaactgcagagactcaggagaacaagcccaaacacataagcacatcccaagcctctgcttacatcacaaatgtgaacatcccagtttccaaagcaaattaggagtccaaagtgggagagctctgaaaagttatatgacaagggatatgatatttactcctttttactacagaaagaaggaagagttgaaatagtgacagtttacaattcaaggtggaaattggtatttttaatagtttaaatagtcacaaatacattatttatatgctattttttaactatgtttattttttaaaaaatagaaaaataccaccataacacattaaattaatatgatgtttccatgtacatatatacacacgtatacataagttatatatatatacacacatatacatatatatacacccacatatacatacatatatatatatgtgtgtatatatatataaaatcacttatgcagattctgaaaaaaattagttaagacaccaggctccaaatatttaaattaagtgactatcctatcatgttttattcaagaagtaaggcttcagtatacaagattttagaattgactcttcattttggctttcagctgtgtattcaaatatgtactgctgatggtgcttcccttgtgactgatattatgatgatgagactaagaagtgtctttcaagaaatattatctgacagacagtatcttgattaagatgagctttaattaagataaatgaggctgcttattcatctgtttggcatcatgagccctgaatcctcagaataatgttaaaagtatttaaaaaattccattttcttattgaaaacacaaattagatttagagtgtgtagcttgcccacctgcactgtaagcatggccctgttagaaagcactgatgctgcaatttcattacagtgatctctcaacagaatggacttgctgagtacaaaacagcatacagggatgccagtcagcaggattggttttagaaaaaaaaaatgtttttaaacaaggttaagcctaattggtgctgatatgctcttcatttattttacagtgttatcatcttttctgtattaattcattcgtattctccaaagaaatgacacagtacattaaactttgactttcaccacttgtacttgattggaataacttttactagtatctgtattagttttatgttgctatgtaacaaattgccataaatgtagggtcttaacacagcaaaaaattaataactcagagtttccatatgtcaagaccaagcatgggttaagtagatctcctgctcagggcatccccatgctgaaatccaggtgctaattggagcagttatcttacttgggctcagggtcttcttcccaattcattccagttaattgcagaataggtgccttgcaagtatagtactgatgtgtccattttcttgctatctataggccaggcattgctcttagctcctacagtataaacagtatcaattcatatagtcactactttatctgtgaaagaaacaaagaatacaaagtatgatttcaattcataaaaagcaaagagtaaatttaaatttttaaatccccattttagagagcttaatctttaacagcatgaagtttatgatagaacttactattccaatattagataatgtggacaatgtgtcctattgaattatgtgtgatagctttttctgactgttttcaaggtataggcccattgttgtgtttttcatagttgacttgaaaagagagaaaaaaacacgagagtagagacctcataagaagttcttctagctgaagtgactcaaattctagcactttgggaggctgaagttggtggatcacctgaagttaggagttcaagatcagcctatccaacatggtgaaaccctgtctctactaaaaatacaaaaattagccaagtgtggtggcacacacccataatcccaactacttgggaggctgaggcacaagaatcacgtgaacccggagaatggaggtggcagtgagctgagatcgtgccctgcactccagcgtgggtgacagagtgagactgtctcaaaaaaaaaaaagaaaaagaaaaggaagaaagagaaaaaaagagagaaagaaagttgacacaaattctgctacccagggataagtcttagcaatggcaggacttcagaggggaagctcacatagaagcaggttagttctaaagaatcagggctgtagcttgcactagccagggattgcaggaaagtttccatatctgctgatgcctttataacttttactgatggacacataaagtacaaagtggtttaattatcacttttgtgtgaagtgagtcttaggacagtctgcataacccttagaaagggacaatctcaagaatgaatttattgtgaacaggtaatagaataaaagtgtagttgacatgtaaactatagaaatgcaacatattttatttgtatgagttgtgaacttaaatttatatgtactattattcagtgtcttctgtgacatgcttgtgtaagataatctttgaaatatacatccctcacatctctcatctctgccatttgttttttcttacaataggaaattcctttattgtgtttcttcaatcacctaaacttaactttagtataaatacaggaaagcattaaggtagctacaaagaaatcaattgcttcctttttgtacaaaaagcttagaataaaagccataattatagcccatttaatgatttgaggaaggcattttcattcctatggaaaagataccagcttttaaaaccccagctgctcaataggatttcttagtatttatagatctctgttaatgcaactccacatagagagtctatggaaaacaaatgacttaattaatgttactccataaattttcttatttttttaaatacagaacttgccctaagtgttcttttatcagtctttgacattgttgattatgcccttcctttgcctttatagtgcattctctcatttttctaaatacatatgtggccgtttctgaatatttttaaataaatgttgctttcttaacatttaaatattgatatgctttagagcctacccataagcccactcactccctttatatatcttccatcatcattatatatgtattttttctcttaatttatatttctagtcacagtatgtcccctgaggcccagacatttataattaatattagaatgtctaataaacacctcaaaatcaatatgccctaaattagttcctctcctgtgatttccttctgaataagtgatagtagagactcataactgcttcaaaaggaaacacttttcattccctctttccaggaaaccaaacaattagcaaatcctattcattccagatttaaaacatttttcatgtatgtctacttcactggatcctacccaaatccagatcaccaacatcttttgtggtatctaatggacatagctggactttctaccttgtgtatgatctctacaaaattcattcatcatcacactctctaagatacagatgtgagcatgtgactcatttacctaaaagacttcatttattccccatttcccttcaaagtaaaatcccaaaacttagatatggaaaataaatggcagacaggaggcaggtctaacttgcagcaccctctcagccagaaagaccagcatgtggaggctcacattgtgaacttttactctaaaaacaggaacataccaggaaaactgaaggaacccacagacactttgaaggaggtggattgctctgcaggctctgtgggacagtggaggaactgtgaatcggcttgctttctcagctgggaggcttgtggcctggggcaagttctgagcctggggcagctcaccagctacctggaaataaactcagtgctgttcagggagcacggtgggagtgagactggccttttaggctgtgggccacataggagctgggtgaggcctgtggctgccagctttcccccatttccctggagaccagtgtgacacagaagaggcaaacataatcctctgtgaacataaattcatttgcctgggaaacacaccccctaccccacagcagccacagcaaccctgcccaaggagagcctgagctcagacaatgcctaaccctgcccccacctgatggtctttctctaccctacctgatagcctaagacaaaggacataatctcttgggacctctgtggccctggaaaatgcctgatcctccctctaccaccgcaactatgtgctactgaaggtgacaccttctggctggaagccagcaacataaaaccaatgcacttaacaaaaatacaaccaaggattctcacagagtccacatcactcccctgctacctccaccagggcaggtgctggtatccacagctgagagacctgaagacagatcacattacaggactctttgcagacactctccagtaccagccaggatactgctatctagatccagatgagaaataacaatcactgcagttcgattctcaggaagccccatccctaaagcaagaggtagagcaccacatcaagggagcactatgtgagacaaaagaatctgagcagcaacccttaatccctggattttctctctgacatagtctaccaaaatgagaaggaaccagaaaaataattctggtaatatgacaaaacaacgttctttaacaccaccagaagatcaccatggctcaccagcaatggatccaaaccaagaagatggctataaattgatagaaaaaaaattcagaaggtcaattattaagctaatcaatgaggcaccagagaaaggtgaagtacaacataaagaaacaaacaaacaaaaaaagatgcagcatatgaatggaaaaatctccagtgaaatagcataaataacaaacaatcacaacttctggaatttaaggacacacttagagaattacaaaacacactggaaagtctcaccaatagaatcaaacaagtagaagaaagaacttcagagctcgaagacaaggctttcaagttaacaaaatctgataaagacaaagaaaaaagaatttaataaaatgaataaagcctccaagaactttggaaatatgttcaatgactaaacctaagaataattggtgtacccaggaaagaagataaatctaagagtttggaaaatatttttgagggaataatagaggaaaacttccccagccttgctagaaatctagacatctttacacaggaagctcaaagaacacctgggaaattcatcacaaaaatattactgctgagtacacagtcatcaggttatctaaagtcaaaacaaagaaaagaattttaaaagctgtgaggcacaaagcttcaggtaacctgtaaaggaaaacatatcacattaacagcagatttctcagcagaaatcctacaagctagaaaggattggggtactatctttagcttccttaaacaaaacaattatcagccaagaattttgcatccagcaaaaccaagcttcataaataaagatacactcttttttcagacaaacaaatgctgagagaattgccactaccaagaaagcactacaagaggtgctaaaaggagctctaaatcttgaaacaaatacttgaaatacatcaaaatagaacctctttaaagcataaatctcacaggacctataagaagataacaataaaaaaacaagatattcaagcaacaaatagcactatgcatagaatagtacctcacatctcaatattaacattacatataaatggcctaaatgcttcacttaaaagatacagaatggcaaaatgggtaagaattcaccaaccaagtatctgctgtcttcaagagactcaactgacacgtaaggactcatagaaacttaaggtaaaggtgtggaaaaagatattctatgcaaatggacaccaaaagtgaacaggagttgctattcttattatcagacaaaagaaacttcaaggcaaacagcagttagaaaagacaaagggggacgttgtgtgataatgaaagtactagtccagtggaaaatatcacaatcctaaatatatatgcacctaagactggagcttccaaatttataaaacaattactgttagatctaaggaatgatatggacagcagcacaataatagtaggggtcttcaatactccactgatcaaattggacaggtcatcaagagagaaagtcaacaaagaaacaatggacttaaactatacgctagaaaagactggacttaacagatatttacagaacattctatacattctatttattagcacatggaacattttccaagatagaccatatgatagaccacaaaacaagtctcaacaaatttaaggaaacagaaattatatcaggtattctctcagaccacaatgaaatatattggaaatcaactccaaaagaaatcatcaaaaccaggcaaatacatgaaaattaaataacctgctcctgaatgattgttggatcaacaacaaaatcaagatgggaattaaaacattattttaactgagtgataagtaacacaaactattaaaacctctgggatacagcaaaagcagtgctaaaagaaaagctatagccttaaatgcctacatcaaaaattctgaaagagcacaaagggatcatctaaggtcacacctaaaggaactagagaaacaagaacataccaaacccaaacacagcagaagaaaataaatttaatgaagattagagtagaactaaataaaatagaaacaaacaaaagaaaaacaaaggataaatagaacaaaaagctggttatttaaaaatataaataaaattgatagaccattagcaagattaaccaataaaagaagagagaggatccaaataaggtcaattagaaataaaatgggtgatatgatttatacaactcatacctcagaaatataaaagatcattcaaggctactatgaacaactttacacacataaactagaaaacctagaggagatggatacattcctgaaaatatacaacccccctagattaaaccaggaagaaatagaaactctgaacggaccaataacaagcagcaaggttgaagtagtaattaaaaagttacccacaatagaagtccaggacctgatgaattcacagctgaattgtatcaggcattcagagaagaattgataccaatccagttctctataaatcattctatgaagctagtatcaccctaacaccaaaaccagaataggacataggaagaaaagaatactacagaccaatatccctgatgaatataaatgcaaaaaatcctcagaaaaatactagcaaaccaaatccaagataatccatatcaaaaagatataataaatgtgtgatatgataaaccatatcaaaaagataatccaccataatcaagtgggattcataccagagatgcagggatggtttaacttctgcaagtcaataaatgtgataccccacataaaaagagttaaaaacataaatcacattatcatctcaattgacacaaaaaagcatgtgacaaaatccaacatccttttatgattaaaaccttaagaaaaattgacaagggacataccttaaggtaataaaggccatctatgacaaacccacagccaacattctgctgaatggggaaaagttgaaagaattcccactgagaactggaagaagacaagagtgccactttcaccacttctgttcaacatagtactggaagtcctaggcagatcaatcagacaagagaaagaaataaagggcatccagatcagtaaactggaagtaaaactgtcactgctcactgatgatatgactgtatacctagaaaaccctacagactcatccacaaccttctagaactggtaaatgcattcagcaaagttttaggatataaaattaacatacacaaatcagtaactctgctatacaccaacaacaaccaagctgagaatcaaatcaagaatgcaatcatttttacaatagctgcaaaaagaaaaaataaattaggaagatacctaactagggaggtaaaagacctctacaaagaaaactacaaaacactgctgaaagaaatcatagatgacacaaataaaggggtacatggatggatagaagcaatattgtgaaaaggaccatactgccaaaagcaatctacaaatcccttgcaattccaatcaaaataccaccatgattcttcacagaactagaaaaaaaaaatcctaaaattaatatggaaccaaaaaaagagcttgcatacccaaagcaagactaagtaagaagaacaaatatgaaggcatcccattaacaaacttcagactataatataagcctatggtcacccaagcagcatggtactagtataaaaataggcatacagatcaatggaaaagaatagagaatccagaaataaagccgaaaacttaaagccaacagatattcaacacaacaaacaaaaatgtaaagaggggaaaggacatctgattcaacaaatgctgctgagataattggcaaaccacatgtagaagagtgaaactggatcgtcatctctcaacctatacaaaaatcaactcaagatatatcaaagacttaaatctaagacctgaaaccatatagatcccagaagatagcattggaaaactcttttagacattggcttaggcaaagaattcatgatcaagaacctgaaagcaaatgcaacaaaaacaaaggcaaatatatgggacttaattaaactaaaaatcttcttcacagcaaaaaagtaatcaccagagtaagcaaacaacccacagagtgggaggaaatctttacaatctatacatccaacaaaggacaaatacccagaatctgcaagaaactcagacaaatcagcaggaaaaaaacaaacaattccatcaaaaagtgggctaaggacatgaataggcaattctcaaaagaatatataaaaagggccaaaaacatgaaaaaatactagacaacactaattatcaggaaatgcaaatcaaaaccacaatgcaatagcaccttactctgcaagaatggccatagtcatataatcaaaaaataatatatgttggtgtggatatggtgaaaagggaacacttttaaactgttgatgggaatgtaaactagtacaaccactatggtaaaccgtgtggagattccttaaaaaactacaagtacaattacaacttgatccagcaatcccaccactgggtatctactgagaagagaagtcattatccaaaaagatacttgcacaagcatgtttataacagcacaattcacaattgaaaaaatatggaaccagcccaaatgcccatcaatcaatgagtggataaataaattgtggtagttatatataccatggaatactactcagtcataaaaaagtacaaaataatggcgtttgcagacacctctatggaattgtagaccattattctaagtgaagtaactcagaaatggaaaaccaaacatcgtgtggtctcattcataagtgggagttaagctatgaggatgcaaaggcataagaatgatagaatggactttggggacttgggggaaagggtgggtggggggtgagggatgaaagagtacacattgggtacagtgtacactccttgagtgatgggtgtaccaaaatcttggaaatcaccactaaagaccttattcatgtaatcaaacatgacctgttccccaaaaaattcatcgaaataaaaaaatgatatgtgaataaatacgtaaatatttaaaggaactgaaatttcaggaataaagttcaaggaaacttttttataaaacttaactctcctgccttttgttttgttgaagttgagtttaatctctctcctattgcaattgtcttggcttatatttcaacagtgttgaatagtctgccatacctgtttctacctctatgcagtgaaatgtttcctttacagcagagaaacgtaacaatcttgtgatgtggcataactgtaacgactccatgatcatgataactatcatgtaaacagcatatgccagacagcaatcttctaagctctctatacatattaatggatttaatctctataattgctcagtaaggtgaattcatctattatcccccttaatggatgaggaaactggaatacagatagactcagaacctccctaatatacacgtacatttttttttaccaaagacttttttagggcagttttaggttcacagcaaaattaagaggaaggtaaagagattccagtgtaacttctgccctgtatatgcacagcctccccattatcaacaaacctgattagactggtacatttgctacaactgaagaacctatattgacacatcataatcacccaaagtccacaattttacattagaatccactcttagtgttgtaagttctatggatttgaacacatgcacagtaacttatatgtatcattatagtatcatacatagtattttgtattaaaggtactctatgttctgcctattcatccttcccttcatccaactcccaacctcaggcaatcattgaactatttactgtctccatagttttgccttttctagaatgtcatgtaactggaatcacagtatgtagctttacattagtccttttttatgttgttgttgctataaaggaatacctgagactggtgagtttataaagaaaagagattttttttggcttacaatttttcaggctgtacaggacatatgatgctggcatctgcttctggacaggcctcaaggagcttacaataatggtggaaggtgaagaaggagcaggtgagttgcatggcagcaagagaagcaggggaggtgccacacatttttaaacaaccagatctcatgtgaatgcagagtgagaactcactcatcagtaaggggatggcactaagccatgcatgagggatccacccccatgatacaatcatctcacaccaggccccacctccaacactgaggattacatttcaacatgggattagaaagagacaaacagccagaccatatcaagacttttcagattgacttctttcatttactaatgtgtacctaagtttcctccatagcttttgtggctagacagttcatttctttctagcactgaataatatttcatagtatggatgcaacataatttatctattcatctactaatggacaccttggttgtttccaagtattggggattataaacaaaacttttatgaacatctgtgtgtaggtttttgtgtgaacataagttttcaactcacataggtaaataccaaagagctgaactgctagacaattaggtaagtgtatgtttaactttgtaataaattgccaaactatcttccaatgtaactgcaccattttgcatttttcccagcaacgagtgggagttcctgttgctccacattcccatcagcatttggtgttgtcagtgttgcacattttggtcatccaatagctgtgtaacagacgaagtagctcattgttattttaattttcatgtccttgataacataagatgaaaagcatctattcatgtgcttatttgacatatgtatatattcttatttatatgaggtgtctgttaaggtctttggcccatttttaaattaggtttttgtttttttattgttgaggtttaagaatattttgtatgttttggataacacttctttatcacgtgtcttttgaaagtactttttcgcaatctgtggcttgtcttctcatttcccatgacattctcttttacagagcagaagttttttattttaatgagtccaacttactgatttgttttttcactgatcctgcctttagtgttgtatctaaaaacttatttctggctgagtgcagtggctcatgcgtgtaatcccagcactttaggaggccaaagcgggtggatcacctgaggtcgggagttcaagagcagcctgtccaagatggtgaaaccccatctttactaaaaaatacaaaagttagccaggtatattggcagatgcctgtaatcccagatactcaggaggctcaggcaggggaaattgcttgaacccgggaggcggagtttgcagtgggccaagattgcctcactgcactccagcctgggtgacagagcaaaactctgtctcaaaaaacaaaacaaaacaaacaacaacaacaacaaaaacttatttctagtggtttctgggaggaggcaaagcaagatggccaaatagaacactccagtgatcattgcaccacaggaataccaaattgaacaaagatccacacaagaaagcaccttcataagactccaaaaaaaaaaatcagctaagcaatcacagtatatgattgtaacataatatcaaggaaagagacattgaagagggtaggaaagagagcttagagagctttgcacaatatacatcacccctccctcaaccccaggcagggccatgtggagagagaagctgtgtacttgtgggaggaagagcaaagtgagtgtgggacttcgcattggaactcagagctgtcacagcagaacacagcacagggcagatttctaccagcacctatggaaggaacatttacaccagctggaggccagaggtaaattctccacccaagcagaagaaactcaagtccttgcttcatcaccaaatgattacattggcctggaacccagaatgaatttgatcggcagtcaggccacaaagactgaagcccttggaaaattcctgatgctgcaatggtctcagaggcaggagatgtgaggtgtgacccagctgtggtggtcgaaaagtttctgcattacccctcttccaaatccaggccattcaactcagggagaaactccttccacttggggaaaggaaagggaagagtacagaggactttgtcttatattttgggcttagccacaatatagtaaaacaccagagagattcctgaagcccccagttccaggactttgctcttggacaatatttttaaaaccactctgggccagaagggaacctgccaccccgataggacaaatacagtcccagcaggatttaccacctactaactgaagtggccctgagccttgtataaatgttagcagcagccagacgagtggccacaggcactgggtgagccccagttccatgctggcctgcaaggcttaggtgcaacattgtgctgtgtcagccacggtggccactgtagggcccagatcactctttctctgactccaagcagcccagtgaggagagactccttctgattaagggaaaaagagagaaaagagtgagagactttgcctggtaactcagataatttgcctttatggtcctgaagtccactaaggctgtgcctttagtgggggtctgtgggagtcgctgttcctgggctaagggagctctctagtgctgaaacagctgcaaaggcttaggtcacaatactcaattccctttgaattcttggaaagccttctcaaagaggacaggtacaaagaagctaagactgtgaagattcaataaatacccaactcttcaataccagacattgacaaatgtccacaagaattaagtatatcagtaaaacattacctcaccaatggactaaataaggcaccagtgaccaatcctgaaatgatggagatatgtgaccattcagataaaaagttcaaaataactgtcttgagcaagttcaatgaatttcaacatattgcagagaaggatttcagaatttcatcagagaaatttaacagagattaaaataatttttaaaatcaagcaggaattctgggagccaaaatgttcaactgggaaaatgaaaaataaaatacataaaagtctttcaacagcagaattgatcaagcagaagaaagaattaatgagctcaaagacaggctatgtgaaaatattcagttagagaagaccaaaaaaaaaaaaaaaagtacaaaggattagcatgtctaaaagatctacaaaatagcctcaaaagggtaaatctaaaagttacttgccttaaagaggctgtgagcagaaagacagacatagatcagggtagaaaatttattcaaataaataatagcagagaactttccaaacctagagaaagacattaatatccacgtacaagaaggacaaaggataccaggcagattcaacctcaagacatataataaagttcagaaggtgggttcaagatggctgatcagacatagctagagtgcaccagtgtcatggagaggaaacaaagtgttgagaaaatagtggctcttcaagtttctcatcttggagaccacatcagtattcatcaaagaagtgagaggatccacagagaacagacaggagcaaagtcacgcagctgcccacccggcactggcctggagctgggagaagcaccctgacatggggaaagggtgagtgagtgaaagccaccggggatccacactttccacacagactttagcaaatctgagcatgggaaagagagaagaatgctcttgagccccacagacatctagactgactcagagagccttctggaatttttaaagaggtaccgctcaggcccacgtggagcccagaaagcctgctacactgaaacaagtagctcaggacaccaggcactctattgtccaactcttcacctgaaacaacaagagagtgccttacagtaaacaaaggtcacctgcttgtgtaatagctggctcatacttgtaaacaccatctactattctataggtcaaattgcacaacccaacacaaaacttgctgacagaagtgaataggaatatagtattaaaatgaaaagacactacctaacacaaccctcagcaaatgagaaggaatcagcataagaattctgtcactgaaaaatataaatgttgaggcatcaccaaaggctaactctagctcttcagcagtgatctctaaccaaaaaaggagccagagaaatgacagatggataattcaaagcacagattgtagagaaactcaatgagctccaaaataaggttgaaaatcgatgcaaagacacctgtaaagcaatccatgaaatgaagaggtaaatatcttgaaaagaaatcagtcagagctattggaactaaaaaactcacttaagtaatttccaatacaatagaaaactacaaaacaaccaatacagtaaaccaaatgaaagaaaagattccagggctttcaaatccatctagccagacaaaaatacagatttttttttaatgaacaaagaatctcagaaatatgagctgatgcaaagtgtcaaaacctgtgaactactggcattcctgacagagaaggagaaatagtaaataacctggaaaacatttgagggaaaattttaagatcattcctctaatcttgctagagaagtagacatcaggatataagaaatccaaaggccttccaaatactatacaaaatgaatttcaccaagatgtgtagataccagactatgtcagataaatgctaaagaaaaatattttgaagacagcttgagaaaaaggtcagataacatacaaagggcaaccatcaggctaacagcagacttctcaggagaaattctcaacccagaagagactgggagcctgttttcaacattcttaaagaaaataaactccagtgaagaatttcatacaccagaaaaactaagcttcctgagcaaaggagaaataaaatatttttgataagcaattgctaatggaattcattactagaccagccttacaagagatcattaagggaattctaaacacatagatgaaataacaatattggctgccgcaaaaccacaccaaagtacatagcacacacaccttttaaagaaaccacaaaataactacaaaacaaccagttaataacttcatgatagaatcaaaatttcaaatatcaatattaaccttgaatgtaaatggtcttaacaaaccacttgaaagacacagagtaagtagtaagttggattgaaaacaagacccattgtctgctgccttcaagagatttatctcatgtgtgacaacattaatagactcaaagtaaagggttgaagaaagactgattattcaaaaagaaaacaaaaagagcagaggctctattcttatatcagataaaataaacttaagccaacaacagtaagaaaacaagaagaaggatactacataataataaaggattcaatccaacaagatgacttaactatcctaaatacataatgcactcaacattggagcacacagatatataaaacaaataattccagacctacaaaaagacttatacagccacaaaataatagtgaagaactttaacaccccactgacagtgtttgacagatcaaagcagacaactaacaaatctggggcttaaatttgacacttaaccaattggacctagtagacaactacagaatctaccactcatcatccatagaatatatattcttcacatttgcacacagaatatactcttaagattgaccaaatgcttggccataaagcaagtcttaatacattcacagaaatcaaagtcattccaatcatactttcagactacagtggaataaaaatagaaataattacagaaaagatatctcaaaagcacacaattacataaaaattaaagaatttactcctgaatgatatttgggtgaaagatgaaattaaggcagaaatttaaaaatttcttgaaataaatgaaaacagagaaatatcaaaatttctgggaaacagacaaaacagtgtaaagaggaaacttacagcactaaacacctacatcaagaagttagaaagatctaaaataaacaatctaacatcatacttgaaggaactagaaaaacaacaagaaatgaagcccaaagatagcagaagaaaagaaataaccaaaaccagagccaagctgaataaaattgagattcaaaaatccataaaaaggatcaacaaaaccaaaaattaactcaagataaattaaagacttaaatgtaaaacctaaacctataaaaattctagaataaaacctaggaaataccattctggacatcacccttgacgtaaaaaggattttataacaaagacaccaaaagcaatttcaagaaaaacaaaaattggcaaatggagcctaattaagcaaaagatcttctgcatggtagaacacattatcaacagagtaaacaaacaacctacagaatgggagaaaatatttgcaaactatgcatctgacaaaggtctgatatccagaaactgtaaggaatgtaaacaactgaacaagcatgagcaaataacttcattaaaaaatgagcaaaggacatgaacagggacttctcaaaagaagacatatatatatacaacaaatatattgaaaaaatgctcattatcactaatcattaggaagatgcaaatcaaaaatacaatgaaatgccactcacaccagccagaatgactactattaacaagaaaaaataaataacagatgctggtaagatggcagagaaaagggaatacttacacactgctggtggaaatgtaaactagtttcagccactgtggaaagcaggaagaatcaatatcattaaaatggctatgctgcctaaagcaatttgcagattcaaggctattcctataaaactaccaatgacattcttcattcttcacagaactagaaaaaaactattttaaaattcatctggaaaaaaaaagcctgaatagccaaggcaatgccaagcaaaaagaacaaagctggaggcatcatgttacccaacttcaaactatactacaaagctacagtaaacaaaacagcattttactggtacaaaaacaggtacatagaccaatggaatagattgagagcccagaatgaaggctgcatatctacaaaaacctgatctttgacaaagctgacaaaaacaagcaatggaaaaagaccccttatttaataaatggtgctgagataactggctagccatgtgaagaagattgaagttgcaccccttccttacactatacacaaaaatcaactcaagatggattaaagacataaatgtaaaacccaaaactataaaaaccctggaagacaacctaggcaataacctcctggacataggaatgggcaaagatttcataacaaagacaccaaaagcaatcacaacaaaacaaaaaattaacaagtaggatcagattaaacttaggagcttctgcacagcaaaagaaactattgatgagtaaacagacaacctgcagaatgaaagaaaatgtttgcaaagtatgcatctgacgaaggtctaatattcagcatctataaggaacttaaccaaatttacaagagaaaaataaacaaccccattaaaaagtgggcaaatgacatgaacagacacttctcaaaagaagacatttatgtggccaacaagcatacgataaaaagctcaacatcactgatcgttagagaaatgcaaatcaaaaccacaatgagataccatttcatacaagtcagaatgactattattaaaaagtcaaaaatagattctggcaaggtttcagagaaaaaggatcacttatacactgttggtgggagtataaattagttcaaccattgtggaaagcaccatggcgattcctcaaagagctaaaagcagaactaccattttactcagcaacctcatcaccaggcgtatacccagaggaatatgaatcattctaccataaagagatatgcatgcaaatgttctttgtagcactactcacaataacaaagacatggaatcaacttacatgctcatcaatgatagacttgataaagaaaatgtgctacgtatacaccatgaaatattattcaaccataaaaagagtcttttgcagaaacatggatagaggtagaggcagttatccttagcaaacccatgcaggaacagagaaccaaataatactgcatgttctcacttataagtgggagctaaataaggtcaatttgagggggcagggtgtgatgaaggagaggagcagaaaaaaaataactattgggtactgggcttaatatctgggtgataatatgtaccacaaacacccatgacacatgtttacctatgttacaaaccttcccaagtgcccacaaaccaaaaagagacaagtatagtaattatataatgataaagggttcaattcagcaagaggataaaacaattttaaatatatatgcactcaatgctggagcatccagacatataaagcaaatattattagagctacagggagagatacattctaataaaataatagcttgtaactttaacacaccactttcagcactggagaggtcatctagacagaaaatcaaaaaagaaacatcagacttaatatgcactgcagaccaaatggacctaacagacatttaggaagatttcatgcaacaactcttgaatatacattattctcctcagcacatggaatattctcaagtatacaccatatattaggccacacagcaagtatcaaaaattcaaaaaatttgaaatcatattaagtatcttctctgactacaatggaataaaactagaaatcaatatcaagaagaactttggaaattacacagacacatggaaattaaacaatatgttccttatcaaccactaaatctatgtagatattttaaaaaataaaaatgcttgatactaatgacaatggaagcacaacatacccaaaacctatgggatacagcaaaagcaatactaagaggggaatttctagcaatttccatcaacagctacatcaaaaataataaaaatcaaataaacaacctaacactgcatcttaaaggactaaaaaaataagagcaaaccaaacccaaaactagtagaagaaaataaatcataaagatgagagcagaaataaataaaattgagacttaaaaaagaatacaaatatcaatgaaccaaaagatgagagcataaataaataaaattaagacttagaatgcaaatatcaatgaaccaaaaagtggggtttttgaaaagatttttaaaaaatcaacaatcttttagccaaactaaggaaaaaagagagaagacccaaataaataaaatcagaaatgaaaaatgacacagtacatctgatcccaaaggaattcaaagaatcagaggctattataaacaactgtatgtcaataaactggaaaacctagaagaaacgtataaattcctagacacatacaatctaccaaggttgaatcatgaagaaatccaaaataatgagacagaagcagtgataaaatgtcttcctttaaagtaaagccaaggacctaatgtttttactgatgaatttgaccccaaatttaaagaaccaataacaatcctactgaaactatccaaacattgaggaggaaggagtacttccagagtaatcctatgaagcaaacgtcaccctgacaccaaaaccagacaaaaatatacaacaacaacaaaaagaaaactaaaggccaatatctctgatgaacaaggttataaaacttctcaagaaaatactagcaaactgaattcaacaatacattaaaaagattattcatcatgatcaagtgggattcatcccagagatgcaagtatggttcaagctatgtaaatcaatgtgatacgtcatatcacatatcagaagttttgcctggattaactaatactgtcaggtagagtaacataaaggttgtgattattcaatggtccactgattgtgtcagcagaaaagtctcagaggtctctacaagaatggttaagtggagaggtagagatcaaaaaccaaaatcagattagaaacctaaagactaaacaaaacaagaaaacatggctatcctactaaaataatgaaaaattgagataattaattacgttctgctgctggcatttaatagcttagaaaaagagtcctttggctttcagtttaacacctcctttgtcttttgtttatcttagagaaaatatcatttccaaggataacaggttaaaacaaaggagaattaactaattcttcattcataatatacactcaagacatttttaaaaaagattattattatgtgaaaaaatcaactgaactaaagccatcattttgaacaatgataaaaatatcatgttaaaaatctcaacaaatgaatggttgactgccctctttccatgttcgctgcctatgtctataacctacatcatccaaattgataaaaatcatgctaaacataagatatgaatttcagctctgacagccatgttgagttacagaaatattctgcaaatacgtaagttcatacattcatgcttaggtgatctcaggccttctggtgcctcttatacttggagagtgactgtataaattgtacaaaaactgtttgtgtttgaactatgcagccataaaaaatgatgagttcatgtcctttgtagggacatggatgaagctggaaaccatcattctcagcaaactgtcgcaaggacaaaaaaccaaacaccgcatgttctcactcataggtgggaattgaacaatgagaacacttggacacaggaagggggaacatcacacactgggaccttttgtggggtggggggaggggggagggatagcattaggagatatacctaatgtaaatgacgagttaatgggtgcggcacaccaacatggcacatgtatacatatgtaacaaacctgcacgttgtgcacatgtaccctagaacttaaagtataataaagaaaatatatatatgtataaagaaatatataaacagttggatatttatatttatatttaaacagcaaaaaagagtacctaaattgtttgagacatatgaagaaaagacataagaaaaaaggccaaggaattatgatagaatatgtctgatatctaggtctaaaaagtcagatacatgaaatacttaaccaataatttaaagactcacagtgcttcctgcctggatcctggcacatctgtggctctggaattcttatatgtcctgcacatgatggttcactctacacctgctttttgggtaaagaaaatgagccatttttatactttgcttattatcatattactagccttgttatccataaccacatcagagtctcctgcaacttcactctacttttctcatgtagttctttattattcatacaaagcatactttttatagcagaatttaatactagaatatatacgtttgtgtgtgtatacatatatagtatatttatgtatatatatatatagtatcctgtgtgaagaaaaaattttttcttcaattaaaatacttatttttctgaatacaatgaccctgaacaatatttttgcttgacttttaaaaagataaggtgtttaaaatatgtagactcttaaaatttttgcaaatgttgcaaatgtgttgcagactttctgtagacataaatcagttaaaggtcaacaaatattatgctaatttatgtcatttgtttaggccaatggttgatgatgagtatgtccataagaaagctgcaaatttgttgtctctccaaagatacatgtttttaaaacaattttaaaatcccaaccagaatattccaaagctcactttcctttttctctaaaattagactggcagcaaacactgaaatgagttatggagcctgacatctaattaacacagtctttataggtttaatgagcagtgataaatttctatcctttttttggcacattttaattagttgtaattatgagtggagtgacctgaaaagattgttgtcccacagaatcacagtaaatttgtataatttatatttgcagggacagaatgtgtttttatgacatgaaaaacaaaaaggttatttaagccattatagtagtcatataaaatcttacctaaagctcagataactaaaacattgggcattcatattttactaacatcaggggagatgcttcataagcgcatttatcaagatcatttctctagagagttgttctttgcaacttgtgtgcaacctgaactcagatatttatacatatgtatatatacatatatatacacacaaacatactatatatgctatgttcatcttattagtaaggaaaactatataaaaactatatacatttcctataattcttaatattattttaaagaatgatatgatatgatatgctttaaggaatagaataaaagaaaaagtcttcagtattcattaggaataaaatgtaagacaaggcagatactctccttaatgttataaagattcccatgtagcagaagagaaaaacaaacaattctcataaatgccaacatttggaggacaccaggtgcacacaatgggaaaacctatattgcaactgaaggatcagtgaagactctgaggagtgattatgattattgtgatgatgatgacatgaaaaataataatcaacactctctttgtggttacttattgctggacattgttataagagtttacacagttcttcaataactggtaatttttaggtatgggagaactaatcagttgaattttctcatataaggtaaagttgcagagagcatggaaagtctagtggatagcagattatattcagaaattcacatttggtagaatacccccaaaatatacattcaatcactttcaaaaggagaaggggtttattttcgccttcctttaacatttctgcatttcaaacctcttttaatgcctactaaacaccattaataccaagttggaaccaaagctccattccctacaactttcaacttctgccctgtttcctacactacaatctacttcgaactatcatctttacaaaggaattagtatcccagtaatcttaggataattgtataagcttcctatcctcataggctttcttcagagcaggatcctgcaattacacatctgccattgtcaatatgacatatgtattttgtacctatgaaatgtcttcctcaatcatttatgtaattatttctgtgagatgttatagtggattttattatacaaatacggctgcagcatagctttcattctgcaaattaatatataatgggacctcgatattgttcccagaaatcctcatatatgtaccttcatttgaatgagcaggggctgacatgactcatttgtaaccaatagaatgcagcagaagttacaccgcatgctttctgataatacattagaaaaagcaatgcaaattatgccttgcttgctggaacactctatttgaagccctgagccagtgtataagcattatgactaccctgaggctaacaggccaaatagttcatctggaaagatcccatagagaggtcacgtgaccacattaagggagagaaatgcctggctagccattattagctcccgcgtgagccaccacgtgattacaattgcacatgagagcctgacccaaaactacccagcctagtccatcctaaactcctaccatgcagaagctgtaagcgataataagtcaattgtttcaagctaataagttttgacattatttgttacttagcaatagataaatacaaagaaatttttgtattacattttataacaggctgtgctgtgctgtccaagtgttcctgggatcctttatatattgcagggccattttcccactctttctactttcctttacttcttagtattattgcctaatagaaatcttctgtaaaagctgtctttaaatgtgaacactaaaaggaggatattatagttgcacagctactgtcttgattcaactgccagtagattctaagcatattcctgagaatcaaaggctttcatggcccaatccctgcttggcagctgtaatgcactatggcttctggcaagtcacttaacgtctatggaacatcttattcctcagcaaaaagacaataatacttacctatcgcacagcggtattgtatggtttagatagggttgctctctgaaaatatgaaacactataatttcaagacaatattataaacctactatcccattttcatttctgaccatatggagtgggacctatgaggattttgtatctagtgttcaaagtttccactatttaaattgtcaccttacaacctactacgttccttactaaccatttaaatactaaaataaaaaaatggctaaataaaaatccatgtgctatgctgaaatgggtgctcttttgggtttcattttcctaacttttcaggacatttgcaaagttttatgagtttttaacagtctcaatctatcttggatctgcaaaagaaattttactctactgtacttttaaggagtccatatcagggaacaatttgctatggaaatctaagggcctgattaagttttagtcaaattgtctttaaaaaatcacattaataattcatgctccattggttattgatatgcattatttggctcaaaaacatatttctattaaagaggcttgtattacctatacagatttttttttaaataaggacttagaattaggtaaattagttcccatttatttattgattgattggtttttattttttgagatggaatcttgctctgtctcccactctggagtgcagtggcgtgatcatagctcactgcagcctcgaattcctcaagtgatgctcccacctcagcctcttgagtagctgggactacaggtgcataccaccacgcctggctaatttaaaaatattttttaaagacaaagtctcactgtgttgtccaggctggtctcaaactcctgggctcaattgataaactccttcctgccttggcctcttaaagtgctggattgacaggcatgagccactgcacccaggcaccatttaattttaggatagagcacatcatggatggaacacataagaaatactgaaaacgtggtttaatatagtttaaataaacatttgctttaatataatttcaccaatattaagggaaagggaattaatccatgcctttattgtacttcaaacctgtaattaatttaaataacaatatcaacaaagtgtagcagtgtttaaattgagctgactatgcccccatgcccacagaggtgctaaaaataaaacagaaatataaaattgtcttttaaatgagaaagttaatttcatgtatttttcattaaaatatttttagttacaaagagtgagaatttaatcatttttttcctaatagacaatgcccatattggctaatacataacccatcctcgaacctgggtatttataagaaaattagactatttaggtttgagtcatttgacatttgagtgttgttaatctcttttgtgttccataatgtattttgtgtcagtttcatcccaaatctgaactctctccataagaagtattaagacacaggtggaatgcactgaaatttacctaataatctacaaaaaaaaaaaaaatcagcaggattcagcatagcttttgctgtttgtttgtttgtttctataaaaaatttaatgccttttgttattttaaaaactaaaatatcctggccacggctcaggactccccaagcaggcagtctgcagtcttctgctgacagctgcaggagaagctttgtgtcctccatctgtcaccaaatttcctctaactcctgctgctgttctaccatcaccaatccgtggaccatggagctcctacctatggggcaccccagcacttttctttaagattaaagccagaaatccagtcctctgaaatggacattatgtcatagaagactttcacagttggagttggaacttgagaaacaggattaggcgacagctacatatggccctccgtatgacaggaagctctgcatcctgaggaaaaccaaacacattgcctaatcccataccatcctcttcatgcaaaccataaattctggctctcataattcaaatctatattcaccactgagtaaacagaagtcccaatttttactgaagaaaatcctacattaactgccattactatccaatttagactccccttaacacacctaaacaaataatcaaaatcccattgcaaatttcagaaaaaatgttaatatgctaatgattgagttaggaagtaggatgataaagtcaagggattctttatttagttagagggtaactggaatccacacagtttatctgtgaggtgttatttgtgattattctcagtaaagtaagtaatttgaagctaggcattgaatgaacaataagagtttaactgtttcaatactatgggtttagaaatctaaggatgctaatatatatcaaaataattagtaaataaaattatactttaataggattcaacatagattggaaatctttttaatttcagcatttttattaaagcaatgatcaacattttattttgaagctgggggtatctgcaacaatggagtgaacacataagaaatactggaaataatatattaatataatttaaccaaacattgttttaatataatttgaccaatattaagggaagaggaattaatccatatctttagtgtattcaaatatgtaattcattttaatgacaatatcatctaaatttagcaatgtgtaaacggggctgactatgttcccaggaccacacaagaccttaaaataaaacagaaatgtaaaattctcaatgttacatattaagcaactcccatttttaccagctctatatttataaattattctatcatttacaatataaatttaaaatcatggttatgcctccctaagcactactggctatgcagttataaaaccaaactccataatactgcagaacactgtacaataaaatatctacacaatactgtgcaaataacatttgaaaaatagatcatatttttgatatggaataggttctatatatatatgtttagatataacacacaacatatatatatacacacacatacatatacatacacatacttatctagagaataaagtaaatgaatagtgagctaaaaataaaatgtagggcttcctcactgtcagtctcactttcagtgaaaattagactgtcagttttattgacaagtgtcctggaaacagttttgaattcaacaaattacagtttttataggaataatatcaagtatatgggaatatttaagcatttggctatttagtttaaagatcacagtggaagaagctgtgacattatattaattgctgaaatatttcttggttctttaaaaaataatgttttctatattttagaattattcattaatttgagtagtaaacctctaacattcaaaaagaataaactaataacctgaaatatattcagtaaaaatatgttatatttcattttgcagtatttgccatttctatgtgttcttctatccaaccttcaaaatgttaatcccagtgtctcctcctggaattttttttctaatctatatttcctactaaactatgagatacaaaagagtgggaggcattttatcttctaaatctggctcaatgcctggccttactgagtattcagtagctatttttcaataaatgaatatgcttattatatagctattattctaatctccactaacagtatagtccatttgatcaagtaatccttttagagaatttggctttttatgaatctttaattcatagagtatgaatgttgatattgttattcaatcagaaaattacttcaaaaaatgtatatttgttttttttcctgctttgatcctccagaattttactcatcctgtttttaaaattataaaactcacctgcctaatgcatgttgtaattatctttattgtgctattaggaataggcttaacatttctggttactataaattatataaaagcaacacaactttgcaacttacatttgatgcataattttgaaaatcagttatttctcctgtatttaataattagaagaagaactacattttatgttttagagatactttgtttgaatacaaataccttaaaaatatagtatatttcaaaacagtaatattgttgtcacagatgagaatatctattggaaatagtgatataattcttggcatactctcgcaatagcttatattatgtttagaaaataatgccctggtggaagtcagctggctgacccacgacctacaaggacacaatataatggaatgggtgttacatttcagagctaagtatacatgtttgtaggtcaggcaacttgattttgttagtcttccgaggtgatccagctcttttccactgactcatttttgttgaaatcccattaatataatattcagaatgactgttttcttcaaagtactataatcaatctaacctgtgcttgctacccagaatgtctatttatgatggacaagatgcgtgaagaatgattattattgaaagtcatctttaagaagaaaaacaaggggagttagtgatctttaagactataaatctgatagcctgatgatacagcttctgaattaaagtctggcaaattagggcctgcaggccaaatccagtctgttgcttaaatgtgtgcagacaacccagatagtaattgtttatacattttaagatggctgaaacaatcaaaagaagaataatattccccaacacgtaaaatttgtataaaattcaaatttcagtgtccgaaaataaagttttataggaacacatccatactcatgcatttagaaagtggagaagacaggctttaaaacaaggccaaatgactccagcgcctgtaatcctaatcactgtgctacataattaaaaaatacataataaatatgtcctgactttacatgatggatgttaaattttaaattagttaacattcaataagaatattgcataactgtgttatcaacatactcttgttagcctttatcttttatatatattttaaagtagagctttacaaaaagtaaaatgtccaagttatttaaattttatctaattttagtaaaatatttattgcattcaacactatcatagcactaattaaagattttggttctgtgaaaagattaggtaatggaaattatacccttttccctatttggtcttattctaataagtgagaaaaaacatttacacttgtaagttattttcacctcagtgcttttagcaacatttgcaagtacagaataaatgctataaattaaatttcctgcataaattgtgttacctaattgttactgactgacataaataaagttttaacttcacatttaaacatgcattttctattttctcagatgtatgttttaatgctttaattttctctattttgcaattttggtaaaaaataaaatctggtttttatatagtaaaagttgatatatatatatacacaacttaaatcccaagctagatgttaaaatctaaacgtaaaaataaataaatattggtaacaattttgttgcttttgtactttcaaagtattataattaagattaaagccacttaaaaataaaagattaaaaacatgattttccataaagaatacatctctagatacaattaaacaatttaaatctaggggacaatagcatttactgaagaagatggtttcactcagtattaattcagtaatcactgcgttaacttctctattaacacttaactgtgttaaggtctctattgttgttaccacaaattgagtggcttacatcaacacaaatttgttgtcttacggttctatagatgagtaattcaacattggtctacctagagtaaatcatgctgtcagcagggtgtgttccctttcataggttctaggggagaatccgtttccttgccttttccagctcctaaactttgccacattccttagggcaaagggaggccccttcctccaatgtaaaaaccagcaatattgtatctctgtctgcatttctttcatagtcacatctttcttactcctcttatgccccattccttccccttagaaacctagcaatttcattgtgcctggctacataatgaaagataatctccctattttaaggtcagctgattagcaagtgtactttcatactctaattcctctttgccaataacataacatattcataggatccaggtattaacatgtggatctctttggggagacaattctgttcaccaccataacttatccttggtttcaaattaaaccttacagattctagattctttcattcaagcaaagtggcaactatcaatatttctttctgtttattaatttttctctttgttttgacttttatatatggtggatccactgtagtggcaaattccatgatgggacaaggtagggtaagtatagagttagtgattggcacttagctgatcctctattctctctctctggacctccacatcaattcattttaataatattttcaacagtgttcaagacacataaataaggaatatttcatagggactttaccttaatgaaaaagaaagagaaaaactattgatcaagtttgctaaggtgcctttattggcaaaatgtagatgcgggtcagggtctaaaagtatgaaaggtgcatttggggaaaggaaaacatattaacaacattttgaattgtcacttacattggtctaagtcaacttgttgacacaattcctgtaatcaaaaggagagaaattatgaataaaagtagtagcataagatcagccaatgtctgaaacaaaacaccctaaatcttctgaaaaactcagaaggttggagaaaccccactgtcctcgctctgagaacatgtgtataagccaaccaaaacagagcagatgtgccttccagaatgtggaaaacagtcaatttagatgtagtcagagggatttagccagctcgtccatcttacagaaagcctcttgtctctatatgaggtattaccatgtctcagcaaagtttctccttgccctctcctataaaactgaggcaaatcagaatttgtctaaaaatagaagccatggtggatttcagtacattagataacgtgaacaaaaccatataatatttgtggaattctagcttctttttacctgtaagcctattctctttcagttggatgttttcaagatcccctagcatcaggaacctatcatgcatacttgtctattctgagctagtgccttttgcagtatgctgtttcctttgacctggttagaatttatgactctgttgttcccaggaacactgcgccttgagatttccccagagtccacttctgtctgcagatagaatggacagcccagtctcacactccactggtctattgcttactgaataaggaggccgcctatcaacacatctcctcagagaatgaagctgagaaagtagaaaccctcagagtgtacaagtatcttaaaataaaaggttccctgtaaaaacacaattgtaagagaaaagtcacccaaaaaagccagacccaaaacatactctaggaaaattattatactttatcactttaacaatattttaaaaactactctaggcctatacgcaaacaacaaacaaaaaaactaactttcaaagaaacgactaaaaaacaaaatcaggttgataccatgcttttcaacaagtttcagtaaaataaaaggggatccatatctcaaaaagctcaagaaaagaaaatgtgtatcaagaactggatatctagccaagcagtcttgtatatatcaaagctactaaaaaactgaccatgtaagaactcaaaaatagggtatccctgagcacatccgtaaaagacatcgataaagttgtcagaagagtctcctcaagtagaatcagccctacatactttcaaaaaagaattccaccaaggtttagaaattcagataataccaatctgtttaatctgtttgatatataggaatccattaaaattgattatatttataaattaaagaaacacttactcccatggatactgaaaatcattgagaaaattcaatatatatccatgctaaaagcactcaatgggactaaatagatgctttctaagcttgattacctacgtatttgagaatgtttgtgtattacatatatcgacctcaaagggcaacatcttaattaatggagaaaaactggggactttcttaccaaaaagaggaaaggtgagaacactcaatataatcattactatttgatattttgtggggagaatttgccaagacagttataggagaaaaagaagttaaacataaatgactggtaaaaagatatgtaaaactccctagtttactagagaaaactttctctagttttacatatctttgacatggtggtatgcctgaagagccgaagcagttattgaacaattgaaaatataaacaatgagaaaattcaataaggtaacattacatttaaaaactataacaatcagtattcttcatatatacagataactagtaagatgtattagtagaatacctatataacgcatacatttaaaaacataaaataatatgaaatattttgagaaatgggtaaatatgtataagaaaattcttaaactatggtgaatgttgcaactgtaaaactgggaaaaaatgggggttttagaagatggttagaatgattcaatttcataaagctaattatcccaaattaattaattaccttagtacattaaggcgccaataaaatattattgttttcccctgatattttataagtttattttaggtatatttttaaaacccaataaaaaaaataatagccagggccgggcgcagtggttcacgcttgtaatcccagcactttgggaggctgaggtgggtggatcatttgaggtcaggagtttgagaccagcctggccaacatggtgaaacctcatctctactaaaaatacaaaaattagctgggcgtgatggcacttgtctgtaatcccagctactcgggaggttgaggcagatgaattgcttgagtctgggaggtggagggtgcagtgaggcgagattacaccactgcacttcagtctgagtgacagagtgagaccctgtctcaaaaataaataaaataaaataaaataaaataataatagccaggaaaatctgaaaacagggacatgaagaagttctagccttacaagatgtcacggcctaccataaagaccctagaattcaaatgatatagtatttatccttttatacaaaactagtaaaatacaaaaccaagttcacaagtaatttaagtaactacaatgacaaacagtgaacctatattcaaactaatgggtaatcctgccatattttcattaatgctagtagaagacttctgggtcagagatgaaagatagtatatttctcacagcaataacagtagtcgcagcagcattatttgtgtctattcctcaaatccaaatttccacaaaacaacgtaaaaatagacagatgatgtctgctctcaaaaggggttggcctacaggaggataaccctgagcatagaaacccaaatcttttataatagaaagcaaacatagcagtcctttgctccaaggggagatgtttctgtcccccaaatttgtttgctatgcaaatatccttaaaaagacacagaaatgcaggcacctgcgaataattgtgtctaaacaaattcatttgggaatttaatttattataaatacaatgtcttacatctatgggcaacaaagaattattaagttaaatgatactgagggaagtgtataactattggttagaagatatcattggttctgtaacttacactaaataaattcctggccgggcatggtggctcatacttgtaatcccagcactttgggaggccaaggtgggtggatcatgaggtcaagagatcaagaccatcctggccagcatggtgaaaccccatctctaccaaaaatacaaaaattagttgggcatggtggcacacgcctgtagtcccagctactcgggaagctgaggcaggaaaatcacttgaacttgggaggcggatgttgcagtgaaccaagattgcgccactgcactccagcctggcatttgatagagtgagactctatcaaataaataaataaataaataaataaataaataaataaataaataaattcccaactcattctagatctaaatgcaaaattgaaaccattgatttagctgaggaaaaagcacaaaattcctttatactgagggatagataaagcctttctttgctcaaactctggaagcaataaaggaaaatatcaataatgtttagtatataaaatttaaaactttgtatagcaaaatatgacagcagtggtcctaactgctgcagcagcatgacttacaggcaaggactcctggctccttgctcaaggaaaaagttttcaaccacagcatcacctggcaaagtagagatttcctgcagttaacaatactgtgaagcactgcataatgacgttttgatcagcgacagaccacatgtattatgatggtcccataagattagaatgaagttgaaaaatttcagtcaccttgtggtatcataacgcaatgcattactcatgtctttgtatttgtgctggtgttaacaaacctactgtgctgccattcatataaaagtatagcacataaaaatatgtacagtatataatatgtgatagtgataataaatgactatgttactggtttttgtacttaacattattttggagaatactcctatttattaaaaaaaaaaagttaattgtagaacagcctccggcaggtccttcagaaggtattccagaagaaggcattgttatcataggagatgacagctccatggctgtcgttgcccgtgaagactttccagtgggaaaaaatgtggaggtggaagacagtgatattgatgatgctgaccctgtgtaggcctaggccaatgtgtgtgtttgtgtctttgttttcagtaatacatttttaaaactacactttgttgtttacttatagaataattattctatgaggatagacttatagaataattattctatgaggatagacttatagaataattattctatgaggatagacttatagaataattattctatgaggatagacttatagaataattattctatgaggatagacttatagaataagggtaaaaaagaaaaagatatttttatacaggtgtaaaatgcatttgtattttaagctatgttattacaaaatattttaagaagttaaaaatatctttaaattatataaagtaaaaagttacagtaatctaaggttaatttattattgcagaaagaaatttttcaaatatatttattgtaacctaaatgttcagtgtttataacttctagaggttttttattttgattggatactgcattcaattaaaaagcatgaactatcaaagtgaattgaaactatcaatgtgcatatgtgatttttaaaattctaacttcacttactgagagaacatgaaagcaataatatctcatcttgaatatcacttcatcgtaacacaatttcattgctaaataatatgcccactctaagttatcaggattcattaaagaaatagcttattctattctgtgtcagggaatgttcatggtgaaactgagaaatattagtgtaacagaaaacaaagggatgcaaaaatctaaggaaatcatataaaaaaggcagaggagtggcttgaaaaatgttgtaccattgtacaaagatgggactgtcattctgctgaagcatttttagttttaaataaaatgttttatataattttaatgacaaaaagaaaagtatttgaaataaaacacacaaattcttacaaaacaccttagaaataatggtagctcacagttgccaggaataaattgtgttgtttattattgtatcttaacaaaaaggaagggaggaaaggaaggagagatcaagattgcttttcatagactttaatagccatgcccctccttgtgaaaaaaaaaaagaaaaagaaaaaggaaataaagttatacaaataaaactagataagactagattgcatctttgttcattaaccaaatctagaacattaggttggtaagcttaagagaggtaatttaaaatatattcaaaggaatattgttcacatgtcatattaagtatattcctagcagagatggtggaatctgagattataaaaggcataaaaattgaagtttggccagaaaatgcagtcactatatcaagcaaataaaaaatcactgggctgagacaaaccaaatcctgtagtaaaacgaagaaagtgatttctatttctttggttcaaagaatgattatttaatttatagtcaatatcagaggaaagaggaagataaatagagaaaagaggaggaaggaaaaataacatatcttaaaaccaaagtcatctcacaaaaatatggaaggacttcactcttcataactagataaaggagagttttgatttttactattagctatgtagccttcaatattattttaccctcagtcagctcagtttttctcctgtgaaaaatgtgagtgatactaattcaagcacatgctaatgtgtaacagaagtaaacatcacagtaaaacagtactaccattttacactaaaaggagtggcataaacaaaagtgatattgagttctagagaaaatagagatttcttgaatttattcaaattgtttagtgcttttggagggtttccaaaaattctctattaatctctcctttattagtttcttacagcaatcacaggaagtacatgagaacagaaattcttatcctcatttaaaaaaaaaaatgagtaaagcttaggaaaatgaccttagggaatacccaagatcacaggctagctaagtgaagttgggaatcatttttttgacttcatgtttcttcctacttaaatgtccagtagccataaagcggacacagcaatattcaaattcatgttgacttctttttttcccccctaaatcaacccacaaagatactatccgagttattctacgaataaaaccccatctagaaattttcattctgtcatcctcctattacaaaaaagagaagactcagtgacttggccatttaaaagttgattgttctgcttggagtagtaattttagcatgtattgaacagttcttgacaggagaataaactttccatgtttaagttgtaacaattttagaaaaaagcaaattacttatgtaaataaaaattacatatttaatttaaattatgtatttacagaagccccacatgtgtggttttgctttccatgtttccttgagaagaaagtgtgttctgctgctgttggatgatatgttttgtatatttctgataggttcatttgacctacagtgttgatcaagtccattatttccttatttattttttgtttgaatctcccatccataattagaagtagaatattttagcttcctgctattatttaattgctatttgtctctttagtttttttcaccatgtgctttatatgctttatgttagttgtacatgtatttataatttatatatttctaattaattgttgcttttatgtttacataatgtttttctttctctcttatgacagtttttgagttaaagtctatttttgtgatacaaaaatgaccagtaatgatgaccattttttcaaatgtttgttggctgcataaatgtcttcttttgagaagtgtctgttcatatactttgcccactttttgatggggttctttgtttcttttcttgtaaatttgttgaagttctttgtagattctggatattagccctttgtcagatagatagattgcaaaaattttttcccactctgtaggctgcctgtttattctgatgatagtttcttttgctgtgcagaagctctttagtttaattagatcccatttgtcaattttggcttttcttaccattgcttttggtgttttagtcatgaagtctttgcccatgcctatgtcttgaatggtatttcctaggttttctggtagggttttatggttttaggtcttatgtttaagtctttaatccatcttgagttcatttgaggtgtcagaaagggatccagcttcagtttagtttcctgcatatggctagccagttttgccaacaccatttgttaaatggggaatccttttctcaatgcttgtttttgccagatttgtcaaagatcagatggttgtagatgtgtggtgttatttctgagggctctgttctgttctattgttttagtaccagtaccatgctgttttggttacttagccttgtagtatagtttgaagtcaggtagtgtgatggctccagctttgctctttttgtttaggattttcttggctatgtaggttcttttttgggtccatgtgaactttaaagtagtttgttcaattctgtgaagaaagtcaatggtagtttgatggggttagcattgaatctataaattgctttggtcagtatggccatttttatgatattgattcttcctatccatgagaatggaattttgtcacaggccttttctgcatctattgagataaccaatccgtttttgtcattggttctgtgtaagtgatggatgaagtttagtgatttgcatatgtggaaccagccttgcaaccctggaatgaagctgacttgattgtggtggataaatgtttttgatgtgctgctggattcagtttgccagtattttactgaggattttcgcattgatgttcatcagggatattggtctaaaattttctttttttttgttgtgtccctctttttctcttgtttcgaatagtttcagaaggaatggtaccagttcccctttgcacctctggtagaattcagctgtgaatccgtctggtcctggacttttttaggttggtaggctattaattactgcctcaatttcagaacctgttattggtctattcagggatttgacttctccctggtttagtcttagaagggtgtatgtgtccatgtccaggaatttatccatttcttctagattttctagtttatttgcatagaggtgtttatagtattctctgatggtagtttgtatttctgtgggattactggttatatcctctttatcattttgtattgcatctatttgattcttctctcttttcttctttattagtctggctggcggtctatctatttgttgatcttttcaaaaaaccagctcctggttttgttgattttttgaagggatttttatgtctctatctccttcagttctgctctgatcttagtaatttcttgtcttttgctagcttttgaatttgtttgctctcgcttctctaattcttttaattgtgacattagggtgtcgactttacatctttcctgctttctcttgcgggcatttagtgctataaacttccctctatatgctgctttatatgcgtcacagtgattccggttcattgtgtctttgttctcattggtttcaaagaacatctttatttctgccttcattttgttatttacccactagtcattcgggagcaggttgttcagtttccatgtagttgtgtggttttgagtgagtttcttaattctgagttctaatttgattgcactgtggtctgagagactgttatgatttcaattcttttacatttgctgaggaatgttttgcttccaattatgtggtcaactttagaataagtgtaatgtggtgcagagaagaatgtatattctgttgatttggggtggagaattctgtagatgtctatttggtccagagctgagttcaagtcctggatatccttgttaattttctgtccgttgatctaatattgatagtggggtgttaaagtatcccactattattgtgtgggagtctaagtctctttgtaggtctcttagaacttgctttatgaatctgggtgctcctgtactgggggcatatatatttatgatagttagctcttcttgttgcattgatccctttaccattatgtaatgaccttctttgtttttgatctctgttgatttaaagtctgttttatcagagactaggattgcaaaccctgcttttttttgctctccatttgcttggtaaatcttccttcatccctttattttgatcctatgtgtctctttgcacgtgagatgggtctcctgaatacagcacaccaaagtgcagtatctgggccagaacgcaccgttcctcccggtagtctctcacagctccgctttcatgattctgaggcacttataggattcacttcatttgtttcctgtctttgggagattactgtttttttcactagtttatgtccaatgttttaattgtcatcataacatattttgtccaatttcttattgtttcagatagaactaagcaagtcccttttattctactttgtataaaagtataagttccagtttaacattttttatctttctcaatatatagatagatataaatattagactaagatatgtatgaacagatacataatttaatattaacaagaagaatgccttggaaagatgatacatcacaagccagttgtagtgtgcatatatatttatgtagtttcatacacgacaactggcttgtggtgtatcatcttaccaatctatttttcttgttactctcaaattaaatagagttgtattttcacaaaataattttggttcgagagaagtaatggttatagtaatgcataaatttaatttttgcgccttattttttattcatatcaactctttttttttttttttgagacggagttttgctcttgttgcccatgctggagtgcaatggcacgatctcggctcaccacaacctccgcctcccaggttcaagcaattttcctccctcagcctcctgagtagctaggattataggcatgcaccaccacgcccggctaattttgtatctttagtagagatggggtttctccatgttgaggctgttctcaaactcctgacctcaggtgatccacccacctcggcctcccaaagtgctgggattacaggcgtgagccactgcgcccagcccaactctttgtttatagagaacaataattcctcaattactgagaacttgaaatattctaggtatttcaaatttaaagtattaaattttatgtaatctcacaactaaaatttttttaaatgatttatttatttttttctgaggaacagggtctcactctggcccagtctggagtgcagtggcataatcatagctccctgcagcgctgaactcctagactcaagcaatcctcctgcttcagcctcctgatttgctaggactacaggcttgcaccacgatgcctaattttttttttaattttttgtaaagatagggatctctctatgctgcccaagctaatcttgagctcctgtgctcatgcagttttcctgcccgtcttccaaagcactgagattataggcaagaaaaaacaaaacagtaacaatccaacaaaccagaagcatagacaatttaaatgatatgctcaagattatagagtaatacatgccaacctttggacttgaactcatacagcataactcaaaaccttatccttactctttggtgctatatttactgcttccgtatcagttgttctcaactctgactgcacattgttgtcatctggaagaaatttcaaaacacactagctctcaggtacaatccccagactttctgaaataattaatttgcgattggtttgacattattgttaaagccccacagttatcagaatatacatctggtactaagaaccattgctctacatgacaatggcttgtgaaatagaccgacaaaatatacaagtgattgcatgaagaatcaagcatcacccaatcaatttattgaagtacgtgtgtaccaagacaagtgaaacaagtcataattactctaattagcattcctacaagctttcaaaggctttaatgctaactactttgtaagtctaaaaaggcaaaactcttgtcttgcctaacagcataaaggaaatcactgtctgtaaacctgttagtgattaagaagattttagtctgtcaatccttggaggcaattaccttacaagagggcactcagtttgattttccaaataaaatagcaactcatgtttaattatatggagacgaaggagaagaaaaaattttttgaatagatgaaaattagatctatttttccagacaggtgaaaagtagaaacagaatatatatagctagcataaaactttaatccatcttagttgagacctcatttttatagctctttcagccatatttatccctagcaatagtccctgttcttaagtctttttcttgggatataattttcttatagaacttcttggaatcttctcatgttgtttccacatgagacattgccgtgatgagatcattagttcctctgctactctcactaacaatctttgtacataatttgtaagatgcgtttccttcataatcattaagtacttcactacgctgttctcagcatttttgtagatttagcaatgtatatgattaattgtcattttgcttgatatctttcttccttatatgtcatgggtttatcaaaatacaaagtatgtattatttttcctgagaagctatggtcctacttaaggacgtaaatacttattgtacatgactgctacctgtttgctctgcctctaagaaatctttataccaaaagtatccttaagtgatagttatcatcactgcctcttgcatgttccaaaaacaaacacaacacagaaaacaaagggaggcaaatactcaccaattcccgctgaataaaatttacattatcttttcagtcacatttaatgcatcttctcttctttgctttttgtgtttgtaagtaagccaaacacaagtataggaaatacttttaatggatcgtatattttcttgtctctatgccttagttcgtgggttaaaatagcctttcttttctttgcattgatccactagttaaaatgttatgtgttaaatgaagcttgttggttcatgaaaataaatttttctctccctctttgatgggaccataaaaatcttgcttatatattcattagtgtgcatatatgttactgcttttttcatgaaattttaagccacttcaaagcatgagaccttgatttactgatatttcaatttcagcatagtttttcttacataataagaaccttaaaatgacagttcaattcatttaacttcattttacaaaccatatttagaagaaactttaagctgcattacttcagtatgatcaaatatgtatctgactggtggtagatataaaaggtcaattaatatttaaattccttgatattataagtatgctctatgataaaatgatagtttgatattacaaatgttttctgcatgagataatggttagtcctttaaaagaaaatgtatgtttttatattatatatactactgtatcttagttctgattcatttgttcattttgcactgaattttaacttacaagcatttaaaagaatataaaacactcatttttaaaatcttaggagtagatcaaaaaaacttttgtaaattttacatatgaaaactttgcagctggaagataagtaaacttataattagacagcaaactgacaattcttaccatatgcaaatttgtgattggatatgacattgacattgggaaagcctaaaccacaagaatgatttatttaaaaaggcatttttgtaaagatttcaaatgatgaggaatgggtgtgttctctgatagtttcttttctgctgttaactaggtcatgtttccatggagtgctacactcaaggaaaaggggacaaaagactaaatagataatcgtatagacagttttatcttctaaaatagagaacagtctgattagagaatgaatacatttaaaatgtcctcctcaacctatggaaatatgatggttgagactgatttgtgtattatggaaaatctctctagatccggtagcactacatattttagacttatgatccctaaaattgaaatatctaatcatgcacagatgtacacattttagcatctctctagaatattgatgctaagaatatatctgctgacatattaaacatatgtctaggggtagtaccaatggttttgcatttatttcacctttaatattgacacttacatgttgttaaatatgaaagtgaccaataagtatctcagtactccagaatatcctctactagtttcactcagctgcctgaagcattcctcttttctgatgtttgtgcaacgacaagcaggctagtaatctcccaacagagctttgtatgctgctttaaataacagcatcccaagagggtttttccaagaaaaaaaatgcaatcatatgtatagtttagataacatggtacttgagaaataatgagagttaaatacatgatagtttctactattattttcatttttatgggggttactctaaacctagtgttgagagaagaggcctagagaacagagtcactctaactcaaataagactatgattaaccatgcctgtgttcaatgtcatcttgttccctgaccgcacttagggtcagtttgcttatttttgcagcccaataatgagatgcagatgaactgggaaagaagggagcttatttctgtaactgggtacagggagaaggtctggaaaatatcaccagaccgactcaaaattacaaatttttcagagcttatataccttctaagctatatgtctacgtgtaagtgtgcattcatctaaagacataagtgattaacttcttctaatctataactaagatctgagtcctgaagaccttcctctggagcctcagtacatttacttaatctaaacgggtccaggtgctggggtgattacccttatcttgtctcctgctaaatcttggaagtttggagagttccttcagacccccagtaaacttgtttgtggaggccttgggagtttcttcagacccccaataaaacatttttaatcctaaaccggtcccgttaaggattcctttgttaccttatcatgcttcaaggcccaggaaaagcttgagcaaaactcttggtgggcttttattacgttccagcctttgtataaaagcacaggctctatcagcttttaatatttaacttaaccactcagttactgctgaaacagttgttatggaggcctgggttagtgagacctggcctgccacaatctgacatatgagaagtgtatgcaatggtagataccttgtggatctggattcccaagggtatcaatataaaggcagtggctctgtgaagatagtttccaaatttgttaagaaagataatagaatattttatgaaaagcaatctttctatatttaaaggttttaaaatgtagcaggttgatagcctagaatatttcagaataccttagtaagcattaaatcaaaatactgatatagtactaaaatgtcaacctagtcccctaatatttagctaaacattctgcatgaaaccatatgcaaatgcattacagctagggtgaccaggcaccccatttttgcctgcaatattcttgatttagttttttggccttggtattctatgtgaattgctattgttctggattatttgttgctttaaataaaagtattattatttaaaatattttaaaatgtgccataatatattcagcagacctccactgatacttataacttctgccttgatctcatctagtagtgtgtgagatgcattttaatccatgattaagtcataaagatcaaagatgagtagtagtaaaccatatctcttttccatatctttgtagacataatgtaagcaacatcatcttttcaaggacattttctgagtctacaaagtgttcttagacacaagagtccagggacagttagttcttcaggtatacaggtagagagggagtattccatcctgctgtctctacagccaatggtcaagtggtccatattattaacacactgggtaatcagtcagtatcagcagtgaaaatagtaaatcatataacaagtgtttgtaaaatatatacaagaaatagacattaataagtcctcctatagaaaatatagacagtggtctgaatgtacttcctacagggattttaaaatctagtttgtgatataaattgacagctacttattatattattctgaaattattttatatttcaaaaacaacaatcaaaaatagtgcatgttttcctaggcaagccagaagaatataagcatattaatgtatatacattacatatattcataaataaaaatatacataaaaatgagacaaatgcatatataaatctgtgcataataacatctataaataagactgtatatacataagaaaaagacaaaactaacacacaaacccaagtaaacagatcgacacaaacaaacacagttatctttacatttattttatttttaaaagtagttgtttttaatttttgtgggtatatagtaagtatatatatttatggtatccatgatatattttgatacagacatgcaaggtaaaataatcacatgagggtaaatggggtatccatcgtctcaggcatttctcttttgtgttacaaacaatccaattatactctttattttaaaatgaataatcaaattattttgactatagtctccctattgtgctatcaaatagtaaatcttaatcattctttctaactattttttgtacccatttactttccttaccgccccccatccctaactacccttccaagcctctggttactatcctttcactctctatcttcatgagttcaattgttttaatgtttagcaaagtttctctttctgtgtctggcttatttcacttaatataatgacctctaattccattcatattgttgcaagtgacaggatctcattctttttttggctgaatagtactccattgtatatatgtatcacattttcttttatctattcatctgtttttggacacttaagttgtttccaattcttgctattatgaatagtgctgccataaacatgggaatgcagatgtctccttgaaacactgatttcctttctttgggtaaataagtaagagtggaattactggattgtagggtacctctattattcgttttttgaaaaacctccaaactgttctctgtagtggttgtactaatttacattcccacaaacagtgtacaggagtttcctttcctccacaaccttgccagcattttttattacctgccttttggataaaagccatttaactgggttaagataagattgtagttttaagttgcatttctccgacaatcaatgatgttgagtaccttttcctatacctgtttgccatttgtaagcctttttctttttgagaaatgtttactcgggtcttttgtccatttttaattggattactagatttttttccagtgaagttatttgagcttcttatatattctggttattaatcctttgtcagataggtagtttgcaaatattttctcccattttgtgggttgtctcttcacttttttgattgtttcctttgctctgctgaagctttttaacttgatgtgatcccatttgtccatttttgatttggttgcctgtgcttgtgaggtattattcaagaaatatttgccctttgcagtatcctggaaagtttccccagtgtttttttgtagtcgtttcatagtttgaggtcttaaatttaagtcattaatccattttacttgatctttgtatattgcaagagacggtgtctagtttcattattttatatatggttatccagttttcccagaaccatttattaaagagacttctttccccagtgtaagttcttggtgcctttgtcaaaaatgaagttgactgtagatgtgtatgcatttatctctgggttttctgttctgtgccattggtctatgtgtctgtttttatgccagtgctgtgccattttggttactataactgtagtataatttaaggtcaagcaatgttttcttctttgcttaagatagttttggctcttctgggtcttttctttttccatataaattttaggattgtttttattatttctgtgaagaatgtcactggtattttgatagagattacattaaatctgtagattgctttaggtagtatggacattttgacaatagtgattcttccagtccctgaacatggactgtcattagttttttgtgtcttcaacttcttgtgtcaatgttttacagtttttattgtagagatttttcactttttcagttaaattagtattttattttatttgtagcttttgtaaatgggattactttcttgatttctatttcagattgttcactgttacacacccttaaatttatacaagggaccactgggctattttgttacctgttggtagatcagaaaactaaagattttacaggactatttccctgctggttttatgtgagtttaagttgactgcaaacacctcaccacaaattttaagttagatgccaagcgacatcaccaccctttaaggaaaaaaagaccacttctcctgaacctattaatgagaatagatgctcatgatttacacactagtacctagtgttatctacacattagcatacaatagctattttcagtgggtggagaagagatttttcatggagaagaaaaatgactagatttacctcttagtagattgcattgggggcagtgctagtgtggatggcatcagatggtaccagggtggaggcatagtcaagccaggattgaactacactgagggccattgtgggcttttgtgggccgggaaaagatccccagactccaaaggctgtcctagaatgaatcttttctgatcagttcaagctggatatagagaagcccacaggcagttcagaaaaatacctggattagaaacacctggagagttaggggcccaagttaattttcaaggagactgacaggcatagaaaaaaaaaggtcttgatttcaaactcttttgaatgccaaagtaggtggtagacaaagaaagccagatccgaggcagagttttggaccctgccttcctagatgaaaaaaaaaaattatatatatatatatatatttgatatatatatatatctcgaatgtgaattaaacattagtgctggattttagttcctaaataaaattaataacaaatgaaaattggcctaaactttgacatttatcctttaccctgagggctatagtgatgttattgattatatgaaattcagaagacacaaatcttctggcaaagtatcaatatatatttactagatatttcaaaataattgagatgtagatagtgatttaacacttgcatgtgtagaaagctggcttagttcatcactatatgaagtatggattttttatttagagcaaataactgtgctgcaaactaatttcactcatttcaagttttcttgtgatcatgattaaaattgcaagattagctgttagtatgtccttccattagcagttgaactttgccccattgaatgggtgccagattctataggtttgtttagatggtttaaactaaaaattagtaacttaattccaaatatgctttgattgatttcatccatgtcattattcattatttagtgtttagtattgtgagtgttcttataaacatagatttaaacttcaacattgaagataaaataatttgcatagctgttaattacataaatacaaatttttgttgaacccaagttctgtgaaaaaaataatagttctacaaaattaaaaatgtatgaagcctgtgtccttagaactcacaattgcattcaaattgcaaaattttaccaatagaaacaaaatggagttttcaaaatgtatatacacacatattctgaataattgttctattgtatctgatgataaagctgatatttaatactgattatacttaagcatgcatatgtgctttctctttcctgaccatcaccaactgaattttactaagttttgaacatttaaatgatgttcaaacttttaaatcaatggtagtaacctaaagatatacagaacatttctttttgtaaattaatactcaaaattttcttaaattttgtacaaaatgagttgaaaatctttaatcatattatttgatatatagaacataaaaaaagttccactattgaagttttagtgtgttgttatgattgaaaatgaggcttaaaatacaaaagcattaaaagttagctcttaaaatagtggagaaactgaaaaaaataaataaataatgagataggatagtctcttgccacgcaggcagctgcagtgaactgcagctcccagtcagccaggcaaggacaagggtaaactcccaatagtctccagtgtactgttgccagatgattttgcttcactgtaggctaatgtaaatgttcttagcatgtttcaaacaggcaaggctaaactataatgttgagtggttcagttgtattaaatgcattttcaacaggttattttcaatttgtaatatgctcactgggaagtaactccatcataagtcgaggagtatctgtaggctgccattgctgaaacagaattagaaacattttacttcctgattcctaataatatttctttatgcctcgcaattctgtttctgttttcttgttctttcagccggaaacagcttttattagtcgatttatatattcagcaaagactagctcaaatgtcacttttagcacacttccccttgattcgtagtgtttactactatcaattttaacctgctcaacacatataaccaattcaattgaaaaaaaaaaagaaacttcactccatataccttgatttttgctaatcagtttttttctttgtagattttatcacttggtgaaaggaaatgttctttattttaaattctacagcactttcctctaataatgaacacatctctgatccattgggttaacgtgtaatttcagcgcattatcgtttttgtttttgatttttttttttttttaagacggagtctcgcactgtctcccaggctggagtgcagtggcgtaatcttggctcactgcaagctctgcctcccgggttcacaccattctcttgcctcagcctccagagtagctgggactacaggcgcccgccaccacgcccggctaatttttttgtgtgtttttagtagagatggtgtttcactgtgttagccaggatggtctcgatctcctgagctcgttatccacccaccttggctacccaaagtgctgagattacaggcatgagccactgcgcccggctgtttttgttttttataaccacaggcatacttaagattataaaaatgttaagccttcaagttaaaatacattaaattattaatttgcctttctctaagtgctacaaatacttgtagaaaaattcttatttgatgataaattgaaggtagaattttttaatattttagtctacatcaagccaatttaaactctttgtgaatagaaatatgagtataaactttttaagacactcagagcacataatattctcaaattaagggatttttagtgtccatggttttctaacctcaattttgcagaaattttaaagtccgtttgtttttgtgtttactagcatggatcttttattttttgtgggtataaggttttaggctataggtatatctctttgatttttctttgctttattgcactttgcacatattgtatttttacaaattaaaggtttttagcaattctattgagattttcaaatagtgtatgcttgctttgtgtctctgtcatattttggtaattctcacagtatttcagtttttttcattttgtatcttttatggtgatctttaataagtgatctttgatgttaccattgtaattattttggagcactatgaactggactcatataagatggcaattgtgatcaatgttgtgtgtgttccggcagttcccccatctccactttcttgggcctccctcttctatgagagacaataatattaaaattaggccaattaataaccctataatgacctctgaatgttaaagtgaaaggaagtttcacacatatctcacttttaatcaaattattaaagttgcaaaaatggttaagtgtagtgaggaaggcatgttgaaaacctaaatagaataaaacctgggcctcttataccacagttagccaagttgtgaattcaaaggaaaagtttttgaggaaatccaaagcgctactccagtgaacacacaaatgataagaaagaaaaatagctttatggaagatatggagaaagcttcaatagtctgaatagaaaataaattcagccacaacatttccttaaaccaaagcctaactcagaacaagtcctaactctattcaattcaatgcaggctgagagaggtgaggaagctgtagaagaaaagttggaaactagcagagtttggctgatgaagtgtaaggaaagaaactttttataacatcaaggagcaagagcaagtgctggtgtagaagctgcagcaagttgtccagaaaatccagctaatatcattgatgaagatggccacagtaatgacagattttcagtgtagatgaaccagccttctattggaagaagatgttatctaggactttcataatgtgagagaagtctatgcctggccccagagcatcctaggacaggctgactttcttgctgggggctaatgcagttgatgactttaagttaaaaccaatgctcatttaccattccaaaaattccagttcccttaagaatactgataaatctaatctgtctgtgctctagaaatcaaacaatgaagcctaagtgacagcatatctatttaatgagtattttaagtccatttttgagatctactcctcagaaaaaaagtttcctgtcaaaatattacttctcattgacaatgcgccttttcactcaaattctctaatggagttgtacaaggagattaatgttgtcctcatgcctgatgacacaacatccatccattctgaagcccacggataatggagtaatttcaattttcaagttttattgtttaagaaatatgttttataaggccatagctgatatagatattaatagttattctcctaatggatctgggcaaagtaaattaaaaaccatctaaaaaggattcaccattccagatgtcattaagaacaataatgaaacaagttaaaatatcaataataacaggaacttggaagaagtagattccaaccttcatgggtaactttgaggggttcaggtctttggtggaggaagtaactacaggtatggtggaaatagaaagagaactagaattagaggtggagcctgaagatgtgactgaatcgccgaaatctcaggagaaaacttgaacagatgaggagctgcttcttatggatgagcaaagcaagtggtttcttgggatggaatctactcctgctgcaggtgttatgaacattgttgaaatgacaacaaagtatttaaaatactacataagcttagttgctcaaacatgaagagtttcagagcattgactccaattttgaaagaagttctactgtgaataaaatgctattgaacagcatcccatgctgcagaaaagcatattgctttgaaaggaagagtcaatcgatgtgacaaactttcttgtacctttcaagaaactgccacagacccccttatcttcagcaaccaccaccttgatcagtcagcagccatcaacatcctttaccagaaaaaatgattataatttgctgaaggctcatatgactgtgagggttttttttttcaataaagcatttttaaattaagctatgtaaactgtttctttagacgtaatgctatacaacacaatagactacaattagtgtgaacacaacttttacatgtactgggaaaccaaaaagtttgttacttgttttattgttgtattgactttattgtggtggtctggactgaatccacagtatctctaggtatgcctgttgtttctgtatataagagtgctactcacttttacatattttaaaaaattgtgcatgtgcttgtatagttaaatattatgcatttgttttgggaaggatgtaatcataacttgagaataatgataggagggcagaatgtcatttttatgccattataaaaattctctccacttgaaagtttagttaatctttttggtctattacagactcacttcttttgtcttatttactaagacaatataagctaatttagtttaatcattttgtggaattttatttatggtaataacaaaacctgaggggaaaaaagacattttctgtagacacacacacacacacacacacacacacacacacacacccgaggcccacaaacaaaaacattttaaaatactgaagtgttttacacctgtctttgtgttctgtactgcagatgctgcgtagtatacaaaatgttattgacatttgtaatatgcactggcaagcagcaggtagtttttttaattttactattttgtgaagtatgatttttctttcaaaatgcttgattatgtagttgtttttgactgcaataatgaaaaagcgttaagttacaaaacagttacttataaaattgtatgatggttagacagtttattctgatacttcactgccaactatttactttgattttacttaaagtggcatttaatgccaatggctaaacatatgctatgtccactacagtaataattgtaccatgttttcattaaatatataattattgtatgaatctctaagattataagccacttctgaaatagctacttccatatatccttttttaaatagacttactttaaaatttttttttatatagattcggagaactttaattagatcagtgtggatactcatgctgattcatttttagttgactgttaatgaatgtgcattaagacgtgtctacttatttccactaaacgatcttatcaacagatgcttacctctgtaaattatctgtcaatatagaagttgatgatgtaacagagaaaatgaagtcataaaattaagtgtttgaaagcatccaatccaactacatattggaattcttgcctccattagtatacattctacctcagggtacccacagtagcccctttatataataattcaggctaatttcctgataatgggttaaaacctggcatggcttaaatgccattatgagacattattcccagtggccacaattctctatgatatatatgaagtgatatatatctagtgtctagtgaggcaaattatatcttgtaattcatttgagcattaaatagttaaccactgcttttgtatttgcaaagactatgttgaaccttcttaaggaatttaaaaaaaattattaaatttattatttctgaagaaaaggcacaggggttcagtaagtgttgatgaacttactgaactctagactgggtttatatgtaatgaaatgtcttagcatttccaaatacctacaaagttcacatgaacgtttaagcctgaattttcaacttcttccagcatctgaagtgtgtacacaccaaaacaaggctattatttaaaattttgagatcctttgtactcctcttcagagttagtttagaattcccaaggatcctttttgctctaatccattgtgtaaaaacacaagacctatgcagaccctctgtagtgattctctaaactgtagccacactaggggcttataagattactaataattagaagatgcaaaatttaatccagattcaggcttttttcttgttgttgttgacactcaactttcagtatattaatttctgaaggttattgttcacaaaaggtatcagttaaaattgttatagagtagtaaaaaatagtaaaaaaggctgggcaagggcaaaccgtgaatttaaagttaaactaacaaattgtaacgtcacattttattccttagagtaaaatattttcattattttagttaattctcattttgtatttcttgactattctttaattacatatcattatttaatttatatttacctaaaaataatggatacattaacaaaaggacagatcttttaaaatactttgggaatttttgggctgaagaaaggacaattataatagaataatataatagtaaattaaagggactgttcaactgaaaaagaaaagaaaaaaatctctattatcttcttagctttataatttgcctgatagaggcccaaaatatatatttatagcaattaatatttgctatttttattatatactcaacacgaagaactctaaaaagaatattaaataagtgaatagaccagtgagacttcgtttaaaagttgattatttttattgtaatgcatatagttaaaaactggaatggaaacaacataaattgagtctgaggtgttcacgctaaccatttactgaaattattgtggctttttcaaaaatcctccacccctcctgccctttctatgcttttttaaaaatagctgtattgagacatagttcccatactgtacaattcttccacttaaagtgtacaattcagtcgagtttagtatattcccagatgctttcatgtttttatctcttctttctcctgctcttttattagccttcccctgacctacttctcaactgaagagtatttttattagaaagctaatgatatgaaatgacctagcactgcgactggtaaattgccactaagaacccgtcctaactgaaccgtattgtaggacactggggtgactgttacacttcactttattaaaacccatataggttaaggaataggagtaataaaaagatgtcttgaggataataagaaaatatcatcggatatgtttatttccaacattcttggcatccaaatcaaaagtactaaagggaaattagagtccctttatgtatcagtggtggtaattctcataaaattgaaattcataaatgcctgccctgaatttaccaaccatagtaatttatgaatcagatagtgctaaagttatagcagttaaagttactatgcatccctgaccatcacatggaagtgtgcataatagtagaggacataaattaggttttatattaatgaaagcacatattattggttcatgaaacaaatcagtgggaatttgtttgtgaactaatgcacaagttacttatatttccacacatttaataagtgatgatgaactccttcaacatattagaacctacaaacactaaaagcctcttaagagttttgtagcctaagcattcatttgggtctattttctattgtttccaaaactactttgcacatgttaaaggcattaatatcatcttaactgctgttgcacattaattgtgcactttataatttaaaaatttggttgcatatatatttctgtgattggaagctatatgcattatgattttacatgtaatcatctggaattgaatcttaattatagagttaccttattttaataggatgttgttattgtttagagaataatggagagttaatttgttgcaaagattaaagctaacacatgttggtgatacatttgatttaccttcctcatagaaggtttctccaacagtagaatgtataatttaaacttttgcataacgtaatttgtgaaatgttttgtatgtcatacaaaaacaaagaattgtcagcaatcttattagaaatataaatgattcctctaagggaaaaacaacccatcaaacattatcttacaaatgtatgaaaatgattctatagggaaaataaatcaactaagcagtattggaatttatttctgcagacattaaataatatgtctactaaacaaatgatgagtatccatagattacatctctactggctcttagttcttcaattaaatagaagacccaaattaaggtattagaacttatcaatatccaattggaatctttatgcctatagcccttctttgaaatgtgactcaggtatctgtgctagtgggacagattagaattcattttgttgctacaatttcagataataaaaatacacaagagccatacgatatgttacccttcctctcacttgcttcttgctcaatctggtattttaaaatagctgcttagaaaactactgttaagtttccaagctgtatagaaggaacaaaaaagggaagaggcatgtgcagtataagcgtgcgtgcacacacacacacacacacacacacacacctgctattcccttaatatggtttgttctcttctcttctcgattaaaatccttaacgtcagggcatgttggtaacttgttgttattatgctgttgttattttctgaaaaacagaaatctttttccagaaacttattttaaggtaatttccctaaataaaaatatcagtaattaaatggacacagataagggaaaagacataatttcattctattcataaggaacctatcccttcaaatctgtgactgagttataagaacacagagggcaaaatagggagaaatgaaatacgttatgatcaagagctacatataataaaaatcagttgtaacaacttaaaagcaagtcttctgccagcctgatctatatatttttgtcctactggatagcctaaaagacatcttacatatcaatagtctaatgtaaagaaaagctatagccttcacaaatcactggaaaaagagctacacagaaaacatgcttgtgttaatgattaggtgggcatggatgtgggaggaaggctgctctttaataggatctatgtttgaccttgtcttatatatgttattgacatctttcagaaatgaaatatgcatgacagcttctaattaagcattgtgatttcttcactagtttagtaacaatgacaacaacaacagcaacaataaaaatacacttcacctgatcaatctagaagaatgtgccttcttcttatcgacgacattcaacattgtgccagttaatttctgttctgattaagtaaatggacactggtcttagactgcaagaattccagctaatctgaaccctaaaaagtttttcctatgagctttgttcatactgagtccttcatgtggcttatcattatctccacctgtgaactcagggtcagctaagggcatttttcatacttactattgcaactcagcagagcattacaacctgaaacatctcatagccaaaatttcagcatgtctctactaccaaaattgattgagttctcattgtatttgtaaacttatttaataagcattctaatttactaagcataatttcgacaagtatttgactaccattcctctctccaaatgtttgaagacattttgaaggtacagtcatttattgccttgttggtcaattgatggatttttctgtggcatggttatcattttttttttgatgatttgaattttagaagcaacaaaagtcttgtttaaaaagagggagagaaaaagacattagcaaaccaggcttcttgtgacatttgaaaagtctcctgctgttataaagggaagagaaaaactatttgaacagaaaagtgattcagttaataataggattaaggaggaaaaattataaaaaataaaagcattttaaacaagcaactagatctgagttacttatgctgcatagtttacacacacacacacacacagagagagagagagagagagagagagagagagagagagagagagaattccctaagagaaaaagggtcttaacatcttatgcatatttctaaagacctaaactacctcaggattaaagaagaaaacatacatcactagaaagtaacacatttgctggcagtctgctctcagcagcttggtataacctaaagataccactgctacatattgcactgatgtaccactacggagtgctggtgctaaggatgtttcttctaaacatatggaattgccccaagctagcaagttgtttaatggcatattggatccatatgttaaagagctggaaattgcttagaagagtgcaaagctataattattttctctgttaccagccagcacattgcaaatcagcttctcaaagatgcagattctccacacagtatagctcaaactttagcttctctttttattttgataaaaatgaatctgaatatggtgttccaataaattttcccctggatcacttatgacatcatcatcttggatgcttttttaaaatgcatattcctgggccaccatcccagactcacagaatcaaatatcttaaatttttgaactcaatagatgggacttcagaatacttcaacttaagctgactcgattgctctctaaggacccactacatttgggaaccactgttgcaaggcacagggcagctggtcacctgcagaaaatgcttggacagagtttggttaaattactgcttaatgcacaggccatattaaatttaaaaagtaacatactattaaactgattgtggatttgttatcaaagaaaataactgccaggcctttaccctcctattcctctattaaggtgttgactgcccactaaagggaaggcttcaaagttgcggtagttctattggaaaacacgccccacacccatccaattttgtataggacaaacttaattggctattcttggttacttttattttagtttagagctttcagtttgaaaagaacaaaggagagaagattgttgaaatttatttacacacacacacacacacacacacacacacacgtgcagcaatacctctaacttgtaccagcaacttcactaaccaaacggcagctgcaagtgtccaatttaattttttttcaattaaatatatttaatttttaaaaataattaggaagcaactactaagcaggggaggaaatctgttccttacactagagattcaataattctgtttcagtttcactgtctaaatttgctttatctgcccctgtttttgcttttatttctaaccctaattttaaagattttttttttgtatgtcatgccccagtcttcttgaacaaagatatgattgggtcgatttatttttagtcaaataggaatcaaagaatggaaagatacctctgtcggaccaacccagaactcaggccttcctcgtgtccagtatgtgaatttttcctttggctagggggccaaagtctagaaatagcaataacatatttggctacttttcttggcagggatgggttatgcacttagaaagttattagtttaggtttacgtgtgaaaaggagggggcaggagagagagaaaaagacaagaaaaggcattttttctttgctgttagaccaatacttcccacccatgcaattcattctataaaaatatccatgtaagcagtgtgaagataaaggtcatttgctagctttccagcagttgtggaggtaataatattacttagctttccatcttaagtattttgtgttgtaaatggcaaattttccagcattccctgaggtttagaagaatgactcagagtgatatcacatcaacctgtttggatatctcagcaactacatagcagattgacagtttttctccattcagtaggttgcttctgtcaaatgacaactactgtcacaagaagaaatgttcatgaattcagtatttattgtctgaccctatcatttcctacttggttcctgattgtcttttacaacttgagaatattcctgataaaaagctacaaagaaaacaatagtgattttcccaaaagcctgcaaagaaaagccctgtcttaaattccatgaaactgagttgtgattccaataatacactgctcaattcttctgaagagtaggtgggagtgaaaactgttatttaacatggttacgtgatgatatttagctaagtattgttattttactttcacttatatccaatcacactttatctgttttttaaatgtcctaccctggaaagaatgttgttgggttattatctgcatgactaataaactcagtgcacatctttctttgcagagattactggagaagattatctgcttccccttataccttatagaaaaggaaaacacctttcagcactatttagtgaaaatgcttgcttgctgtctcctcttaaaaataagggctaaatctttttcattgacatatttaatgccaatcagagtgcataccacaaggtagactcactgtagtaattcatagaatagatagattactaaatgaatggatgaatgaagaaatcagagaggatttaaaagactgttctctctttcacaaagtagcttaacacatggtatctcaaacttaaatgtgcagatgaatcacctggggagcaccaggtaaaatgtggtgtctaactgataggtctgaagtagagcctgacatacttaatttctatctaaggtgatgcagagattttggtctatggaacccattttgagaagcaaggctgaaagtatcattgcaagcagcaaattccctaattcttgactttttaaataagatgaacaattttgacatttaaaatgaatgccgagggttgctatatgatattttaatttttatatttgttagttagaagagaataatataaatagccccttcacattcagttacacttttaaatgtaacagcattttatttttcaaagaagcaaaataatacatattataaatgcagtataatatttattagatctgcacagaatatacttagcattttaaatccttttaggcaaatcatccttttgtacccaacatatggtctgtgaatcaagggcgtcctgaggtccaacaagtccatgagttcaaaattattttcatgaaaaaatgaagatgtttttaccactctgatttttttgaaaactaagatatttgcctttttccattgcaccgacatttgtttggatggtgcaaaagtaatagcttcacagcatgaatcaaccgtggcaccagctgtactattagtcactgtattgttgactgccatgtacttatagtaaaaataacgtcatttcactgaataatatccatgatgaaggaattcacattatactttattaattgaccttaagtacatgttcttttgatattctgtttgatgaaaaagactatgcatacatactttagcataatgatgtagaatgcatatttcaagaaaagcacctgtgcaatcatgtgagttgcgaggaaaacccataagtgtttggtgtttttatagaacacaatttaatttaccttgaaaaaatgacaaaacataatttttctgatctctgtattattggcagacatcttattgaaaatgagggaaatgagtctggcctgtcaaggtaaacaactaacagtatttgttaccaatgatagaattagagcttataaagaaaaccctattattaaaaatttgtatctgccattgtgaatttgacagctcactagtacctaatgcttttctgataaaaagagttatgatatttaaaaatacaattttgtttcttatttttggataatgaaatctgtcaacatttggaagatgtgaatcttccacatcaaaacaatattttccaaatgattaatcacactagaaaattatatatggtacaatatccattcacaagtagggaagatgagtggattttaatgtaacagggtaacaagttcattgatatggctttaaattccacattgaaactaatgagtttttaagtgccatttgaccacaatgtctattgctctcatgtttatgtccatgtgtgttcaatgttcagctttcacttttaagtaagaacatgcagtatttggttttctgttcctgcgttaatttgcttagaattatggcctccagctccattcatgttgccgcaatgacataatttcattcttttgatggctgtgtaatattccatgggcacctgtgttaattccatgtctttgctattatgaatagtgcagtgatgaatttgcaagtgcatgaggcttttaagtagaatgatttatttccttttgtgtatatactaagtaatgggattgctgggctgaatggtagcttggttttaaattatttaagaaatctccagactgctttccacagtagctggattaatttacattcctaccaacaatgtataagtgcttccttttttttctacggcctcaccagcatctattgtttttttgcattttaataatagccattctgattggtgtgggatggtatctcactgtggttttgatttgcatttctctgaggattagtgacactgagcattttttcacatgtctgttggttacttggatattttgttttgagaaatgtctgttcaagtactttgcccatttttaatggagttatttctttttttgcttgttgatttgttaagttccctataaattctggacattaggcctattagagggcggagggaagcaggagcataaaatctacctatagggtgctgtgctcactccttgggtgatgaggtctgtatttcaaaccacagcatcacatgatatttccatgtgacaaatatgcatatttaccctctgtatctaaaataaaagttgaaatttaaaaaaaatcatacctcaataagggtgaaaaaaactcctatttcagcaattattgttaagctaaaaaaataagaaagaaagagggctgatctggaaggaggttaggggaagggaggagcctgctaatatatagggaaaagacggtaaagatgtgtgtgtgtgtgtgtgtgtgtgtgtgtgtgtgttcatatttatgtatcaaaaggaaaaataaacaatttaaaaagaaacatatgaaaaatatataatctgcagtttccatatgccatgttatatgagcgtactttcaatttcataactcatgtctttctataatacatgaaaacaaaattaccaattcaaatattgctcttctattctttcctacattattttctctgaagtatgtcttaataaaatgctgtagtcttctaagctatcctgcattacctctaacacacacacacacactatacacacacaatacacatatgtataatttaaacgattttaatacatatttatgaaattatatatataactgtaaaatatctattagctgataaactgatcatacaattgtacttcatttaattttcagtcattgcaaatgtatttgctagttacaagtgggtgtttatgtgcatgtgaggttttttaataatgctcgtcaagtacttgttaccattgttgaatttacagattccagtgcaaaatatgcattgattttcaaagtgttctcaaacaatgttatttttttctgttctttttgtaatccccatgggataggtaatttagagtgaaaataaaatattggcataaatactatttcatgatactgaaatactgaaaaaaatgagttaattaacctcctctaatgtctcataagtgtaatgacattaaaatgtaatttagttttattttttgaaaaatttattacctaaattattatatatagtggataaaaaggtcaataatctggatacaacattgttcaagcaaatgtatcgcagttttgtataattggccttgtaatggcaaaattctgtaacaggtccactgatgcaattacaaagtgaagtaaataaataaaataatttcctctgttttactctagcggaagggttcagcaaacatttactgtaaaaaaaagcagatagtcaatacttttgactttgtgggctatatggtatctgtggcatctactcaacttcgttgcagtgtgaaaagagccagtgtccgaggctgtttcaataaaactgtaatcccaaaattaatgtggagtcagtcagccagatttggcctagggggttatatttcccaactgcagctccagtaagatgatgacacttgtcactggattactggcacaaacaaatgtttaggcactcagtttaatgttagtaattattagtagtagtattctttctggtttagatgaagagttgaacacacactgtgtgctagtcactgacccagtgtgtacagtatgggaatcaatgatctcaatgtgaagtcaaagttatcgatatatgcttcaccaagaatatcaaatttgatgccgctgcacacaaatatatgctgtgttcaggttagggggccgtagaaagaaaaatcatgaagccataaatgacaaagtgtcacaagctgagttttgaaggataaatacatattgattgttttgaaataggattttaaaagaatacaggtaagaaagtatttgtatttgtctattactcttttgatgtgtggaatttcatgcttatgacaggtatcaggttcagtatatctgacgttacgttttacctttattattgtttttatctgggttgcttatatttctctgatactgtcagctccatgagagtagccactttgttttgtttattgctatatcctcagtcagtcaatgtcatgtggggtttatatcagcaatgatggctgtagaatcccatgcatgtatgtaccccttctcttctggagttctcgagcaattgagaaaaatgaacaggcagatggggcttccatgtgtctctatgactttgtacataggcaatgatactcataataaataacatttcatagggccatcatgggaatttaatgagatgatacctataaagcacttaccgcagtgtgtgtaagtcataattatgtttctaaataaatacaaattaaattaatatagagtttccctcatggtgtatttagtttatatccataataatatttaaaattaagaaagcaacaacacatttaggcttttactgtgttaatggaaaacttaattctacttgattacaattatacaggactcctagattcattccttgtcaatacaaaatgtttctttcttccttgaatcaattgtttactgtgatactgtaatagctttaacattccacttaaatagtttttaattactattatcttagtcacactagtacttaaaatgagacattaaaacctataaatatgggttcctgttcttgtaataggaaattcaagtccacatgttaaggattataaggtaatgttggattaattcatatattatatatgtttgttgtggaattaaaatagcattaaatagtctatttaagagtagagtagaaaaaagaaaagtaaagagtataatctttggtatgatatcatctatgacaaaacccttgatgtggtacagcttcctttgacccacttgatttacctcccatccacctccctcctgctgagtgctgctgcagggcccgtgtggaccatattaagtggacaccatattcaaaggcaatcaccgacaagaaggtgatcagaggaaaggatcagagtgagattgaggtatgtattcttctgtagggtggatgatttcaacctctgatcaggtcacaggcgatcctctcgcttgctctttctctctttctcagtctctctctgtctctctctttaagagttcagggtgatggtcccttcattccttcctttaggcctgggagaggtcactgctcctcctcattttttattagtctcaggatattgccccaaactatgtggtttccctgcattctgctacaactttgcaaataatccttttgtccaactctcctcaagtaatcccaatttgaatgacacatctttttcttcttctccttctccttctccttcatcttcgtcttcgtctttgtcttcatctccatcttcttcttccccttcccccctcctcctccttcaccttctcctcctcctccgccaccaccttcttcttcttcctctcctacttcttcttcttctccttcttgttctcttcctcctcctcctccacttcctcctcctccacttcctctgctttctcttcctcttccccttccccttcctcctcttctttttcttcttcttcttctcctcctactcctccttattctcctcctcctccttttcctcctccccctcttcttcttcttcgtcttcctcttctccttccccttctcttcttcttctcctcctccttcttcttcttcttctgacactgatgatatactttaggtacaaataagagaaaaatagtttggggaatataaattatttttctttactttgaagcttagaggcagataagaatggggaattgaggtctttcaattataattaaggatgcttttctttttttgttgttttgttttgtttttctgggtttttttgtttgttttttagtttgtttgtttgttttgagacagagtcttgctgtgtcacccaggctggagtgcagtggtgcaatcttggcttactgcaagctccaacttctgggttcacgccatcacaccattctcctgcatcagcctcctgaatagctgggactacgggcgcccaccaccacacccagctaactttttgtatttttggtagagatggggtttcaccgtgttagccaagaaggtctcgatctcctgaccttggcctcccaaagtgctgggattacaggtgtgagccaccacacctggccgcttttctttttttgagacagagtatcactctgtcacccaggctcgagtgcagtggcgcagtctcggctcactgcaacctccgcctcctaggttcaagtgattctcctgcttcagcctcccttcaccaccatgccctggctaatttttgtatttttattagagacagggtttcaccatgttggccaggctgttctccaactcctgacatcagatgatccacccgcctcagcctcccaaagtgctgggattacaggcatgagccactgcgctattggatcaggtgattatggaggccaagatatcccagaatctaccctctgcaagctggaaaagcagggaagccactggtatgattcagcctgagtccaaagaccccagaaccagaagtactaaggacccgagatgaatgtctcagcataagaacagagagacaatttgcccttttgttctattctggtcctcaatggattggaggatgctcacccacattggagaggacaaatcttcttcacttagtctactgattcaaatgccagctagtctcttccagaaacacacttacagacatatgcagaaacaaagtttcatcagctatttgggtatccccaaacctaatcgagttgacactaaaattacatcattttaccccatagaaatgttgtaaagttgaattgagataaacttctaagggccctagcagagcccagccatacaaagcacaaataattgcttgtcattgcataatttctactagttgccttagtaaataatattaatattattttcataaagttaactgaagtgaaatcaaaagggatattttgcttattctttttccatcctgttaaatttgttaaatgtgagctgactatattgaattttattgaactttgatcattaaacttgggccttttactgaatctggggctctgaaattacttgacattttattctcattctgaaggaatatatattctttgggttaatgaatacaaagaattgtgataatttaataaaaattaaccaaaattttattttgtctttgaaaactccattactttataagataatactttgttgtggtttttctttttgttttttgatgaggtggtgtggctagaggtcattagatacttttggaagtcgtgtaaatttccagagtctactataaaatttagactataaatgaagatgtgtatttcatagctacaaggatttatgcagttaaataaaatgacatttttgtgttctaatatatttaacatagaattgaaaactcacactgtcattattctaaacaaactccacactgatggaatctttatttttacatactcaggtggaaatatagaggcagacatacttctacatattgttttctcttaattttaaatgaaaagcggtattttaattaggtaatctacaggctgtaatggtaagttagaatgtttccaaaaaacaaatttaagaatccttttacttgagtaaacaatttctttaaaaaatatgttcacattaaaaataatagttttccctgaaaaaaacattctcatttattgacttgatctaagaaatattaaaaatagaatagaatagccaaaattgacaaatgggatctaattaaactaaaaagcttctgcatggcaaaagaaactattggggaaacctgcccccaatatttcaatgtaggttctttctattttccataagtgttggctggctgagaaataaagggagacaatataaagagaggaattttacagctgggccaccagggatgacatcacatattggtaggaccatgatgcccgcctgagtctcagaccagcaagtttttattaagggtttcaaaaggggaggaggtgtaagaacagagagtaggtacaaagatcacatactttaaagagccaaaagcagaaccactgacaagagtctaaaaaagatcacatgcttgtgagggaataggacaaaggacaaaagcagaaccactgataagggtccaacaaagatcacggggcaaagagcaaaagcagaactgctgataagggtctatgttcagtggtgcacatattgtcttgataaatatcttaagcaatagaaaacagggttcaaaagcagagaactggtctgaccacaaatttaccagggcagagttttcccaaccctagtaagcctgagggttctgcaggagaccagggtgtatctcagtccttatctcaactgcacaagacagacattcctagagaggctgtttatagacctcccccaaggaacacattcctttcccaggatgttaatattaatattccttgctaggaaaaggatttagtgatatctttcctacttgcacatccatttataggctctctgcaagaagaaaaatgtggctctttttgcctgaccccgcaggcagtcagaccttatggttgtcttcccttgttccataaaaattgctgttattctgttctttttcaaggtgcactgatttcatattgttcaaatacacatgttttacaatcaatttgtacagttaacacaattatcacagtggtcctgaggtgacatacatcctcagttatggagataacaggattaagagattaaagtaaagacaggcataagaaattataaaagtatattgtatataaaagtatataaaagtactgataaatgtccatattaagatgaaatcttcacaatttgtgttcccctgccacggctacagctggtccctccatttggggtcccttacttcccacaacaagaaactagcatcagcatgaacaggcaaactaccgaatgggagagaatttttgcaatctacccatctatagaatatccagaatctacaaggaacttaagcaaatttacaaaaaaaaaatatatcaaaaaatgggcaaaggatatgaacagatacttctcaaaagaagacatttatgcagccaacaaacatatgaagaaaagctcatcatcactggtcattagagaaatgcaaatcaaaacaaaaactgagataccatctcatgccagttagaatggctattattaaaaagtcaggaaacagcagatgctggagaggatgtggagaaataggaatgcttttacactgttggtgggattgtaaattagttcaaccattgtggaagacagtgtggtgatccctcaaggatctagaaccagaaataccatttgacctagccgttccattactgggtatatatccaaaggattataaattattttacaataaagatttatgtatgtttattgcagcactatttacaatagtaaaaacttggaaccaacccaaatgcttatcaatgatgggctggataaagaaaatgttgcacatatacatcatagaatactatgcagccataaaaaaaactgagttcatgtctgttgcagggacatggatgaagctagaagccatcattctcagcaaactaacatggaacagaaaaccaaacaccacatgttctcactcataagtgagagttgaacaatgagaacatgtagacacagggaagggaacatcacacactggggcctgttagggggtggggggcaaagggagggagagcagtaggacaaatacctaatgcatgtagggcttaaaacctagatgatgggttgataggtggagcaaaccaccatggcacatgtaaacctacgtaacaaacttgcacattctgcacatgtgtcccagaacttaaagtaaaactttttaaaaaaaaaatttttaaaaagaaatagaaataagctttatgctatctagaatctataattatctaaattcaatcctccctttaaattagcatatatctgtatagctatatgtatatagatatattatcatatatttgtatatctatatgtacatatatatctttatgtatagattataaatatatctatatatctacatatagatttatatgtatatgctaagctatctatgtacatatagatatgcagatatatgtatatctttaaattaatatatgtctgtatatctatatgtagtagatatcttagtatatacttatagatctacacatatgtatctgtagctctatattatatagatatgttagcatatagatatagttatatacctatagatctatatatatgctaatatatatacacatatatatacagatatatgctaatatatgctaatataaccctaaacaatagaaacactgacagcatgaatctttttatttacctgattttataatctaagccatatggtgcttgctggaatgacatttatagtgcaagaaaaatctcttgatctaaagcatgctttataatccttattccctccagtgtatttattaacaattttcctaatctgtacatgaattctgaatgaggtttaaattactccatctgtatccctgcttgatattatggcacagcaaatattaactatacaaaagttatatgcaaaaactgaagagacacagtaatttggtaaataaacttgtgtataggatttttcttagaatccacattcagttctatttaaagaaaaactttattataacctgcattttaattatattttacatatttcatactaaatattagtgcagttttcaaaattaattaaacatgaataaaatacactaaatgtggagatcatctttttgtaaaatcagaaaatagattttttctgaattgcctattgtattctttatttttttttatttgcagcagcaaatcttggttgccctttaaaaagcccttcaaattggattaaaatctagacattcaaatggaaaatataagaaagaattcagcatcctcctgtggttaataatttttcctctttcttccaacggttgttgactagcacttctggttgcatcaatgcccgtctacatttaggagaacatgcctcaattctcatgggcagcaagaggagagtgttatattttcccaatgagatcaattgctgttgtatttgatctgctttttcagtgtccattttgtactttgctttttagattttgcactttaactgtggtgatactatttttaagaatttaagtcaaaattacagaggattgggatattaacacattgttgacaattataaatgatgacttacaatttaaaaacctgactatgtgggtgtatcatagtgtccttaatgctggatttgttgttgttgctgtgttcttggcttattttgttcattgaagcacacaacgtatttaattatatcaagcagctgttgtgcaagggcagcagatgttttgcataatgtttatttacattgccataatgtaattcgagaggccattatgattccatctttgtggccaatcccatatttccttcgtagattctgtgggcaatgaacttttatcttcatcagagcttgaagtgaccaaataaactaaataaaatcattacatattactgcatgttttatgagttatggacagcagtgtataatttcttctccacttacttagtgataacttatctaaaaaggcatgcagattataaaatactcagtacaatagcacatttaggcatttacatttggaaacaaaatttgtgtgctccttcagacttctcccaactcttgccttatttttctctcttgtttgatacacctctcacgccagaatgcccaccactttcaaatatgagtgaaacaccctcatctggttgcatgagaggttaccagatagcaaatcgattctcctggaagtgtgagcaagttactcccagtggcatgaaccttaaccagtgagcaacagaatttttacatcattgtggatttgttttcacattgtaatctatgaacttttgctgtttgtttgttttacttttcaaatatgtatatattacattaatatataatatttatttatttatttatttatagaggtgaagtcttgccatatttccgaggctgctcttgaactcctggcctcaagagatcctgccacctgagcctcccaagtagctgggattacaggccaagccgccttgcctggcttcagtatttgctgttaataaaatgaagttacattggtgggctaaacaatttatcatcaggaagtgacccataaattatatttgtttaatattaatgtagctacacagcttcctctttgctagtatttgcatgatttattttttgtttgtttatagcaaccttttttctttctgctatatttttacctctgcctcctttaagctgcagattatcgggtatgacctttttgtttcatccaacatttcttttgacaaagatatttagttcatttatatttatgtgattactgaaatctttaggtttaaatctatagcattgttttgtactttacagttgatcggctcccacttacctttctttttctgtcctttcttgtccgatttgatattattggttatatttttattggcttatttgatcatttgcatttataattttactataatttcaaaataattttacaagaagcttgaaatctttaaggctattactaataaaagtagtctttattctatagtatttaaatatgattattttaatttgttattaaatatgatggtgaattctgtgttaatacagtgagatgcaaaagcagaaaaataaagttacataaaaacatagcttaagtgagaaaagggaaatataataatttatagaagctcagcaaactagtcaaaagtagaatacattaaaatttaatttcacatttattcaagaaaatattttattccaaatattgtcgtccaaaagtggaacagtgttatagttcacagcgtgaattctgctaaatgaacttcttacccattttagctgcggtaaatgctctcaaggaaaacttcagagattgacagaatttctcattccacttatcctcattgacatcaagtccagagtagagccagtgaatgtttggactagatgagtgagcaaatatttggcctcatgggacctaatgggacttaggatatttattagctactttagaataggaaaatataagtacaaatcctcctatgttaatggagttagtgtttggctgagaatatattttacacttcttaggctttcatctctgttccagcttccactgtagttgtcttaatacttctttaatttttgcctcattaagagtgtaaaatgatccttcataggggtgagaaactgattgctgatatcctctgataattttcttacccctcatgttctgtgatgattttagctaaaacatataagaatatgtgttttaaaataagcagtttaattttaggtgtcacgacacctcttggtctctcaatttacgcatacttgaatgaaagaaaatggcttctattcaccaaggatgaaagtaagtttgggggcactaatgttaattatataatagtaaatgttttcaaaatatgtcaaaatatacttcacttgataatcagcataattatttttatgtttaatgttcccctcctagatttttaaaagattaaatataaccccgcctttcttatttctatattttttatttaaatttatttttgttgattttctcagttccaaaaaatgatgattaataaagacctttgcaagaattatgactgtgggagaaatctaatatagctaactccatcttgcttctaacttcacattctgttcttgctcattcctccaactatgggaaaaaattagtttatagtttaactttaaaacaaagatgataacagtcctttgttgaaactaacctcttccttactcaagaactgaaaccacctttgtaaaactaataaatagttcagaagttctgtagccagaagtgacgagatttgtaacctcccaaattattcttatagataacatcactattgtaaaacctgagaaaggtgttttgggtatctcttagacctggcattctgatggaccacctgatgcaacccagactggtaactcatactaagaaactgactcaaggctcggcgtggtgactcacatctataatccaaaaaccttgggaaactgattgacagagcatccctatgcccaggtattcaaggttactgtgagctatgatcatgcctttgcactccagcttgagccgcatagtgagaccctgtctcaattttaaaaattaaaaagaaaaagaaagaaaagtaacttaatcaactggtcttgtgactcctacccaggaactgactcagggcaggaggacaacgtcaattacctatgattttattcctgacctaaccaatcaccattccttttgcctactctcctgcttgccaaactgtccttaaaaaaactgtagcttctgagttcttagggaggtgtatttgagaaatacacccatcctttcacttggctggccctgtgattattcaactctttttgttgttgctgttttgcctgtaatggctgctgttctcagagcactggctttcctggggaggaggcaagaagaccttgttaggctgtaacacatttgggggctcatctgggatagcctttgtgggcacttgccctcagtttggcagcctctcactggtatgacagatctggaggtgagcccaagtggttggactgagggccacctctggtgccatcttggccaatggagcacagtcaacccacagtgcttaaacctactttgcagtggatacatttttgaggggatttgaagaaatctggtaaatattctaagcacaatgaacaaccatatccttctctcagttggttaggctctttgaaggtcttgtggctctttgtgggtttttgttggctctcactaaatagtaggaagggtcttggtttgaggagatttctccccaattagagaatagggtgcctgcttagaagaatattcttataaatttttaatttgcaattttgatttgaaggtcttttatctttcccttgttgtacatatttgtatgtgtggagaaaatcccctgaaggaattgctggtggaaatccagcgggcaaagctaaggaaactctccttgtttgtctcatcagtcatattcaaggagcactgaaggacttgttagcagaagctcagcaggcctaaatcagggcgactatttgctcttccatcctgcccagagaccacgcattgaaactcctggttggaggtcatccctctccaccttgaatggaactaagacaacaggggccaaacagtggcaagtttgaggcttgtcaggttggtacttgggtgctgaacaggccgactagagtctgggtttgttatgtgcatatagctcaagccagaatgagaaatattaattaagttcccccacgcaacccactgggcagcatcttgcaaaacttggaggcttttcctaacggtccatgaagtggaaaatgtgttttataacatggcttggcccccacggctgtggtgcagtgaacaggatcaccagggctactctgccctgctgggggccaggagcctgatgagttggcaaaaggataagaatttctcaccagccaggctcctggtttctccctctgtgctctccatggaactgacaaaagtcactgtttgtccccttggcaagattttgattaatggggggaaaaaaagaattgtgtgagcagtcttgtactatagattttagagatctcttattctaaacagttgatgagaaaattatttctttttttaaaaaagacacataatagtgccatggctagccaggagaattctcttgagcagctaaactcctttacaaactcaaaactggctgctctaggttccttctgggaaaagcagtggcaaatgccccatgatgtagttcatgaaataagattctgccctttcaccatggtggccgggattcaatttttggctcagagaatgagtcctttctggtttgatatttgtgtgacttttgccatttatatcaataatgtgtgtgtgtgtgtgtgtgtgtgtgtgtgtgtatatatatatgtgtgtgtgtgtgtgtgtgtgtgtgtatatatatatatatatgtatgtatatatatagttttaaggcctctattctctccctgtaaaaactcagtcaattgaattctgtctgttttcccatttacctctatctgttgcttctttctcttgccaccttcactgcccacatgggaggacctagcatactttctttctttttgagatggaggcttgctctgtcgcccaggctggagtgcagtggcacaatcttggctcactgcaagctccgcctcccgggttcacgccattctcctgcctcagcctcccgagtagctgggactacaggcacccgccaccatgcctggctaatttttgtatttttagtagagatggggtttcactgtggtcttgatctcctgaccttgtgatctgcctgcctcggcctcccaaagtactgggattacaggcgtgagccaccatgcccagccatacctagcataatttctaacagcctgcgacttcttgggaaaaacagaaaaaaatgccatttggaggaacctctgttttcatcatggaaactcaagagatgtaagcttttacattgtgttgtctcatctttttagcttttgagggtaccagtaattactttgtattttgagaaaatttttaaccttgatatgtgtaatagctagattaaagatatgccttcagagatagctaatggcatttgcttcaagcaaagtgtactcttgagcatgtagaaggtatagaaaaatcctgactccccactgagggataagattcctatgggagatgggctaattacagagtaggttaactggcattgggttgctgatatggtttggctgtgtccccacccaaatctcatcttgaaatgtaactcccacaatccccacatgtcatgggaggaacctggtaggaggtgattgaattatggggggggtctttcctgtgctgttgtcatgacagtgaatgagtcttatgagatctgatggttttaaaaatgagagtttccctgcacaacctctctctgtgcctgctgccatccatgtaagatgtgacttgcttctccttgccatcttctttgattgtgtggcctctccagtcatgtggaactgtaagtccattaaacctctttcttttgtaaattgcccagtctgtggtatgtctttatcagcagcatgaaaatggactaaatacagttgcccaccagcctcaggggaatgtccatacagtgaagtgcactgtaaaaatattgcactgtctcatcccacagtgtttgcatctttttgaaaacccaggatttggtgcaaaaatgggatccttgatttggggatatttattctgccttctagctatgcttgtttctcgcatatgtaaatattaggtgctaaaagcttctgtgctttcttagccctgtttcttcctgtatttcctgaaggctccaacctaaagcctgaatttaattaagacacaagttaaaaagccaaaatgcaactctctggtaattagttggctatcttaaaaccactgtgtaaaacaaattgatatctttaaggaaatctctaaatgtaggagtgcctgcctgtgtacattagaaattctgatgctacaatatttacacctaatgtcttaactctgtgcttttaaaatataaattttgtatctcatttcacctaagagttgtcctttttgaaatgtaaatttagagctgcccagctgacgactgtttagggaagtgaacaagtaatcaagagattgagaatgtaaaatgggtaagaaaaactttacaaactgtccaataaggactgttataaatgaagtgtcttataaactgtaagatctgcttctgtctgtgtgtctgctatgtccatatgtttatatgcgtatgtgatactcatataaacatgcgtatgtgtatacatatgtatgtaacatacatatgcgtatgtgatacgcatatgtttatatgcgtatgtgatatttcactaccaaaatatatgaaagagttttaattggcttaaagaaagaaaaataagtgcttaaactaaatattttattaaaaaaaaaccccaactaactcaaatgtcttttagttcatgtgacttttgcaatctttggtaaatacagttttaaaattattgttaaaataaaattgaaatattttcagaatttagacatttggtctgaattaggcaggtcagatactgtctttgctacatgttttaagatcaggaactgcttctgtgacatttttgataattgtttgacttgtttgttttagagccattagattctaggtaaggcctggggacatgtggagctaggcatgcccactggctatgctgggaagaataaaacattatctgcagttctgtcctgggctctgcacctggtacttaattaaaattacctacctccaattttttcttttaactaaaagtaagagttactaagagttaccattcatacatagcatattaaaagtatgatcgtatttcgtgatatcaagtgttttaaacttttgatatttggcaaaattttacaaatcaaaatttcttttcaaaaaaagttataagaaagcatgttttctggttttcagaaaagaaagtaattatattttagaggcttttaatagttaaaagcacaatagttgtttttaccttgatccttttcaaaaagcagttcataatcagctataagaattaagttacaggaagataggacaaaactgaaggtttaagcaagttgtaggaggtttgtagaagattaatcttctaaaagaaactttgtggaaagtttgctaaaatttaaatgggattatttagtttttctataaattaaacattaaaaccaaaagcatactgatgcacagcagaatctagacctctatgatagaataatagggttctattggagagctaatctactctttaatttaaaaaaaataaaagatttgaaagttttacaaaaatcttattgtgtggtcaaactggttggattaatttctttctacaattttattaaaaattggctttaatgttaataattcatgaataaaaaggtaaatttgtttttttcttttatacaagattttcatgcaatattgaaagatttctgtttgctttttgagtgaactgcaacaaaaaggaaagaaaagaagggagagaggagggacaaatgcagttggcctccttatgctacctttatttggtcttgtattttttgtggaaagctgagtcccctatcaaagggtaaagatttttgcctttaaaaaaatcttgagttatcacactttgaccaaataaatgaactgtgattctctttgttgatatcaagtgttttaaacttttgatatttgatatttgcaaactttttaaaatcaaaatttcagtttcaagttctaaatttcaatgaaatattttgaactaattaactttctttagatgttaggtcccctgacatccaaaagagatataattagcttatatggtgtgttaaataatacaggaagcattgtcaaatatgaaatagtacttaactttctttgggttatagttatataaatgtattattagtacatgttccaaaattacataagatttctatatttctgatgtctcagtatgtattatcagtaataattattattatattagatttttgtgtgccacagagataatcagttttccttgtcaattgtgtctttggctatggctgtcctaagacttttttcattcacaataattgtcttaccttgatcctttttaaaaagcagttcataatcagctgtaacaatctgacaggtggacttgaatgcagatttcttataactttggatattgtgccattggaatagagagaaaagcttccaggaccctcttggagagctgatatgttcataaggacttctggcccaatattgagcagaacaaaacttaatcttaccaactaaattgatagaaaaccaaaacaatcttttagtaatttttttttgtttgaaacattactgattctttttgttttgtttttcagtcaataaaacttttttcatttgagtcatttgcagcttttaaatatttaatgaagtatcctcttgtgagcaaaatttaaagcatatttctttctacctgatttcttctgattttgaaaacttagtattcttaattgatagcaatataattctttgcataaatttaaggagaatatgtttttctttgtaacacaacacagttggagatactggttattttaccaaggctttgacggaatggcacactttcagatataaacagactgctttgaggaattgagattgactttatatagccaataacagcaccttggaaagggggatcttgtgtcttctctatgcaagttctttacagggcttctgaactagtaagcaaagagtgtcactttttggcaggcccagaaacaccaagttatcttgggacatagagaagagagtaactcacccaattcatacaggtatctgcagacacagataaatcctttgctgaactcaaggctttaaagaggtctaatctgatattccttatgaaaaaagttccagcaaagccagtttgaaaaagaaactatgtggcaaataattattcttgattcattttatgcaaataatcaggccataaataataagactaaaacttattttgctagtgaattggtcttactataatttgtgtttaaggggtctgtagagagaaaaattatgtttcagaagaaaactatggtacacttgttattagattccagtcttgttcaatgttttgagttattatgttctacaatttggactgaatcctgaattcttccctggctataagtgtccaagctaatgttttcaaaattctcttccacttttgtgacttggactcaattaaattgctactacatttttcctgaggccctgcaaattgaagctcactccttgtgatacaggtgagacaaactagttagattgccactgccttcttcctctttaactaaagatattttaattctaacatctgatacttcaactgactaccctccagaatctaaggaaactaatttatagattgttcctaatattaacctttgtttttcttctgttcctatagaaatgtctcttattacatatcttttttcctgcatcatatataaaatcctggctcatttgcaatgacactcttgtaatggtacatagatgtttaactgaactaattttttcttaggactagaagtcgactaaaaaagatgtgggatgatatattaaaatctgctcttttctcttgtctttcgaacaatctctgacacaaatctctcgctctctcctaggaccctatatctgcttggttctcagggttgttcccctggaaccctcaatgcttcagatcagtctacaaggacatatgaagctaggacttacacttctttttgtagggctcagtttgctgctcacttacttgctgtgctaaaactgtgaatgagagtactaacatctttgtcatgcaaaccttgggcccccaatcagacacccatgaatacacagataccactgccaaatggtttcgctcctcttaccttgaagccaaaccctacgctaaatatgcctctcatcagcgggaagaagttagggtggatgttggcgttttcccatctctgtagctcacaacttgggaatttagcatgctccagcctaaaaaggggattgaaactgcctttgcaaaagttataacagtgagatcaatctgacacatctaatttaatcttgcttctaacctcacatactgtccttgctcattcctgggtgactattggaggcatttagtttatagtttaattttaaaacaaacatgataacagttcttttctgaaacgaatcctcttctagctcagggattaaagccacctttgtaaaactaataaattagccaccaggttagaactatggttctggagttatgtagccagaggtcacaagatttgtaaactccccagttgtacctatagataacatcactatcactattgtaatctgagactgggttgggcgcggtggctcatgcttgtcatcccagcactttgggaggccaaatcgggttgatcacctgaggtccagagtttgagaccagcctggccaatatggtgaaacctcatctttactaaaaaatacaaaaagtagccaggtatggtggtgtgcgcttgtagttccagctactaggaaagctgaggcatgagaattgcttgaagctgggaggcagaggttgcagtgagccgagactgccactgcactccagtctgggcaacagagctagcctctgcctctaaataaatacataaataaatttgagactggtgtttgaggtatcttttagaacttgcattttgatggattagctagcgccacccagaccagtaacccataccaataaattgactcaaggttgggtatatttgagcatgcctgtaatccaaacactttgggaaactcggggggaagaatcacttgagctcaggaatttgaggttacagtgagctgtgctgggccacagagtgagaccctgtctgaaaaaaaagaaaacaaaaatcaaaaaaacaaccaacctgcatttttcattcattagtcccctggccaccatactgtccttgaaaaatacttgtttccaaattctcagggaggtggatttgaggaatacctcctattcttctggctgaccctgtgattattaatctctttctttgctacaacagtatccttgctattctcagtgcattggcttttctgggcggcaggcaagaagaacccatcaggctataacattaccacacaacttcaaatacatcaaatgtttaaaaatactagaagactgtttctattgtcaattattttctgtttttaaacaaaacagtagtgaatttaagtcatttgaaggcctgtgtctttcagcttactgtagccacttaaattgtaattttagacaaatctttacatacatgaacaaaaatttagtacttcattttttgtgattctataataactttttgagggtctgtaacaaatctcttcaggtttttctttcccaaaatatttgatcatctttacattaaaggtagcagcattccagggatacagtttctgaaaaaaaaatgatattccctactgtttgtggtagtatccaaaaatatcaaaagtttgattcttttttaaagaacattctataattgcttcttttgttcacttctgtatacacacacacacacacacacacaaacacacacccatataataatatgcattatgatccaagctggctactctattaaggctatttgaaattatggtaataataaaaaggtaattttacccatacaagagagaaattggagaatggtaaccattcatattgattttatcaacttgatagcattttgccattcttcacatatttatcagcctgctgacttttaatttcctagggattataatatatttgatgtgactcttacagcaagtatattagtaagtcaagatcatacaaattacactaaatatataccattcagatatactattaaaatttagcttactatgttttaatgaatgtctgtggaaaaggatgtccacttaatgtgtcttagaaaaaaatagagatattatataaaagattaagttgagtagcataactgaagtgccaaatttaatattattgctaacatgtaaacagtaatgtgtctgaagaagttaaaaatactctaccccaaaatatatttatttgacatatttttagatggctgctcagagaacctataaatagtaaccctgcaaaattatcttttgtagggataatttgcatctatagagaatctgtagtgatgctaccaggctttccctgagcccttcccttgcctggatctaggaaagattgactgagaatctgacatcattaaaggtctaaaagaaacatttaccatctgttctctttgatggttacaacctgtgaaatttcatctacataacgaatccatgtttgctagccagtcctcctcttctccccatctcatcagctgtttagccaccatccaaagtcctcattctttctgtaaactcgagatggtatatacacttcttaatcacactgtaatcactctatggttcctccgtgagaaaattaataaattgttatctcatttcactaattaatctgccttttgtgagttgactttttagtgaaccttaggaggaatggggaaagctttcccttggcccctgcacatcattagacttattttaaaacattaagccagcattttatacaattagattttttttcaaaaaatttttccatttcttacacatacaaattaaatggaaaatcaaatccactaacatttacatattgtcttgcccattaccaaacctcctgctaaaagaggtagattgctataacagaagaatatagtgatgcactaggattttgatagtagggatgagtaatgaagggatttattgattgacctttagtgtattaatttatcttattattaatgagagttgcagagtcaatctttttgactcctcatttctttaacattaacattatattaactttgaatcatatttctaatagtattttacaaaaaggagagaagtttatcacttcttatcattcttcagtaatcattataaggtttaacactcttgcctttttttctcattctctctgtctttctcgcttttccctttttctcctctgatttgaaacatgtgaaacaaaagtaatgtgatattttgctgtggtaaataacttctcaattgcaaatgcaaatatatatatataatttatttaatctctatattgtatctgtgcaagtttataagatattctagaaaatagactcaaaggttcatgaagtcaattttgaatgtgtagattaaagattctcaaactttgtgtttttttgttgttgttttgttttttgagacggagtctcgctctttgcccaggctggagtgcagtggcgcgatctcggctcactgcaagctccgcctccccagttcacgccattctcctgcctcagcctccggagtagctgggactacaggcgtccgccaccatgcccagctaattttttgtattgtttttagtagagacgcggtttcaccgtgttagccaggatggtcttgattttctgacctgctgatccgcctgcctcggcttcccaaagtgctgagattacaggcgtgagcccccacacccggccaaggttctcaaactttgaatatacaagaatcatctggaggagttatttaaatacaaattgctctgcagttactgactaaaaatatcagtagtgagttaaagaatttgctttctgaaaactttcctgttgtgctaatgctgctaggctgggggaaatttcagatctattgtgttagagatacagcattgtctcttagctctaactacataatagcttaggaaatacaattgataagagatggagatattactgacccaattcagtgatgcaccaataagggtttcaagactgattttccatttttctttttatgtgagataaaacataagcaaatagacagtgatccatttattgtctcagctctaaatccatctttgtttgctctgttttttgatatagcagcaggacttgtaaatcttccagtcttccttccttcagtgcaggaaccatggattcttatgcaggaagcctagcagcattactcctgtggccttcagagacagttccagtagcactttctggctctcctgtctacctggcagctgcttccaaagctgttccagccacagtcttagggagctttttcccaatcaccaagcagtcttactgagtgtcttcttctctggactagatcccacttgcccaaagtctctggcaaggtctaggccactggcaggttttgtgttctagcggtggctatttttcattgaagattgaatttcagcctggccagttagaagtaggcgtcttctcccaagtaattagtaccaattttgtccatgttcctcagcctagaatattatttgctttattgaacttgcttcttctggtcctattagaattttattttaccatttttagtagataaccatcttttgtttgttaacaattcatgtacaatattattaaattttcctcttcaattaactagagctatttatatttcctgatatatactgatacattaagtaaaaacctcattttttacttaaaaaaaacttgtctattcttgtttcaccagtgaacctccttgctgagtctactgagtgtgtaataagtgagaaagaatagactaagcacagtttagtaaatacttatttttaaataatagtttagaaagcaaacataaacacaacttcaaaatctgttgatgtttgagtaaagttcttgagtacttgggggtcttgcatgaggtatctgaaaattgtatctacttttgatggggcaaataagatattagctctcttttccaaatcaatctttttatagtcagctttgtactgagcctctgcaaatcacatttcttattagtgggctcctgttgggctccaccaccacagggtgctccagagagacgctaaagctgtggaaaaaaaatgaacttggcctttcctgttttgttcctctgtgcatctgatgtgattcctacctccttctttcctttgagcatcacatgcatcttcatcctagcagcaccatttccttctcatacattttcaccccatcacctgctgctcaccaaccccatcacactcagagacagcagcttgctcaatggaggtctagatcccagcccaagaaaatgtcaacatcacagacagacaccaacagccaagcaacacctcctcctcagagccttgagtttcagctctgtggggccctttgtcaaacattaaattttaacaggaatatcctctttcatttgttctgcaaagcctaagagtagtagctgtcttcttcaatattttttcttcctatgataacttaatgatttatttatttactgtctcttaactggttaacaactttatattagattagcaatttctcatatggaaatttttttctgttcaaagaactggtctggtttgtcttttatgagtgaacttttttttttgaaccagagtctcactctgtcacccagactggagtgaaatggcacgatctcagctcactgcaacctccgcctcccaggttcaatcgattatccttcctcagcctcccggtagctgggattataagcacctgccagcggccaggcgcagtggctcacacctgtaatcccagcactttgggaggccaaggagggaggatcacttgcggacaggagttcccaaccagcctgaccaacatggtgaaacctcatctctagtaaaagtgaatgaacttctgttgtgactttttttactccagtagttcagtgggcaggagtgttaacagctcttttactcccaccacctgcagctcagcgagcaggagcattacagctcttttgttcctgctgtttggtgagttctggtttcttgtcccccaaccaaaaggaataaagtacatggacaccagagagggataaggcagagtagaatttattgtgcataagaaaagctcttgacagtgagaaaggacctgatagtgggtagccatctgtgaggctaagtcgggggtttctatatgcttagaatgagggcgtgtttgctgatttgtttatgggtaaacttggaaaaggcaccatttgattggtgaaaaggcatcattcagaaagaaccaatcaaggaagagtgggtaaaacggatacagaagttctcactctggtccgtgaattctatccaaaactggtagctcagttttcaggctttagactgtccttgccttgaaggttgagtttcatcagggacccatacctgtctgtctaggaatttgtctgttttctgtcactatcactttgacaataacagaaattggtacttggagtcatcccaagaaacagaatctgaaatataaagtgttgagttgggtttgcttttgtcctcctgcttgaccatagagctaatgcccttgcaaattggaaactggatattagtaatcggtgacatgcggtagttttatgactaattcagcatctctcttcatctatgtgtaaatcatataggtttttcagaataactgtaaattattgtaaatttaggtagaggctctagttccagatgtaattccctggtaactgatattcacctatttacccggcaaacacttttttcttcataaaatttcacaggaaccaccataactggtttacctggcacagttgtcagtatgctttcaccgttttgcctcagatgtacatcatttatcctactccctgtcatgtcataatttggaaaaatcttgaaattatcccacaaaattacactggataattttattgatgatatacgttaactagaacaaagaagtacacagtgcaaaaacttcaggtgccattgtatgttggatgccatactagctctcctacattgagagattaacctagtgattggagtctacaaacccagtaatgtttctaggagtccaattatctaaatctataattggagtgatcccctctccagtgaaagataagtcactacatcttgaactacccaagagtcccaaagaatcagtgcttgatgagccattatgtatttcagaggcaacatataacacagtaaatgtactaattaaacccgcatatcatcaaataactcataaggctgccaattttgaatgaggatcagagaaagaaaaatgcttgtgaaataatatgttatttatttagtcatattattctgtctaataatgcttttaatcatataattaatttcatggcagaaaatatgcagcagtgggctcacatctgtgggattttcttaccattatgctttcacggggaagcagctgaactaacagatccatggaatgtcctcctgaagacctaattatggcactcgttggtaaaaaagaccttgagaacacaggattcaattttacagaatttcgtatacgcttgaaacagcagccagtaaatgacactgtatcttttacagccagaacgtagaagtattagaaaaaaaggtatgtaaataaaaatggcttctttcaccattaaacccaataataaaataatagaaatttgccttccacaactttcagttctgctggtttagatgtcataggttactagagaagatttcatgaaaggaaaatatcttgggcccccataaccactaagctaaagggaaaattcaagctgtgaactgcttaggacaaatttgcctcccattctattcagagttatccctttgctcactgacataaatgcatatccgattgcctcctttggagaggctgatcagaaactcaaaataatgcaattatttgtctctcatctatctgtgacctggaaacctcctccccacttcgagtcttcctgcctttgctttgagttgtctggcctttccagaccaaaacagtgtacttattgcctatattgattgatgtctcatatcactctaaattgcataaaaccaagttttgccctgaccaccctggacacatatcatcaggacttcctgaggctgtgtcacgggtgagtgttctcaaccttggcaaaataaactttctaaattaactgagacctgtctcaaattttaggggttcacagttttcaccagggaaaaatagttccattgaactataagttgggattgcctcctagccattggaacatctcacaccccataacaaataaggaaaggaagatgttactcaatgggatagtatcaatgatcctgattaccaaggagaaattaaataaagtaatgctagaaactgaagtcaagtgttacttgaggcccttatttgcacttccatgaccaatcgtaaaattaattgatctttaaaggacaacaacaacaaaaacctctacagagaactctgcctcttccagaagaagatttgggtcacggcttcaataagaaatcctccagttgaggttctgattgaaaagaaagtaaatatgaaagctttaaatgtcagctggagccttaatatcagttacagaagcaaggaattaagtacctataagaagggccagatgaggcagtgactaaatattcagaacaacaaagaaaatagtaaacgcgaaggccttgagttaagaaagtaaatggtgtgttgaaacacatcaaaaagaaggagtaagcagtgaactgacaagaagagttgaagagatgagctcagagagataaaggaagacccaagagattataggagggctttggaaatcatgggtacccacatacacatgatttggggtgtaagttggtgaactttggaggaatgtttggcagcacctcaaaaattttgaatataaacactttctcactcagcaacttacttccattttatcctggagacacagtcataattttactcaaggatatgtgtagtaggatgtttactacataatttattactataaagtacaaacaacccagaaatctggcttaaaaatgtgcatacattaatgaaattcaacatagccattttaaagaacaaggacttctgaatttcgtattgacatgaaaaactctccaaggtccataattaggtgagaaaagcaaggcacaggaaaacctgcttctgtttatttgaaaatgtgtatgtatgtttatgtatacatgcatatgtacatatagaacattatggatgaaaaaaagaaatattaataatcttccttcttaagatgataagacaagcctcttttcctatccttgttgcacgttacaaatagttacaccttgcaaatattcataataatgaaaaaaataagaaaaattaataaaatagaaaaataaatagacaacaaatcaatataagaaaattaaaacactatggatgttacacgtgtgcatccatatctattagaacatctggattctctggtatttgtctatatataaacatttacatatttatgtgtatgcatatatatatgtaaatgtttatgaatagttcccaatacactgaataggcccttttgttctcccagttttgggtactaccggtcgacaagaaagtttttaggaccctttatatttttatttacttgtagttgaatgagatttaagaaactgacacagtgtccattatgctgaaacaatccttaataccagggatttttatagcatatatatacacacactcacatatatatatatgtacacacacacacacacacacatatatacacatatatatactatatatatgttttatatatatacacgtatatgtacatatatatgtttgtgtgtatatatatactatatatatgtttgtgtatatatatatatgtgtgtgtgtgtgtgtgtgtgtgtgtgtgtgtgtggtttaaccaaaaaaaatttatagggttgctattgacatcatgcaacattggctaaattgaaaattctttgccaataaatttacaatgataagccaaagagttttagaacacaaaaatgggccaggtgcagttgctcatgcctgtaatcccagcattttgggatgccaagatgggcggatcacctgaagtcaggagttcaaggccagcctggccaacctggtgaaaccccatctctactaaaaaatacaaaatattagccgggcatggtgtaattccagctgcttgggaggctgaggctggagaatcacttcaacccggaaggcagaggttgcagtgagccaagatcgtgccacttcactccagcttgggcactaagagagaactgtctcaaaaaaaaaaaagaatacaaaaatgtttaagccaaatgaattttacttaatttttgcacaatatttttatagtctatactgagctaatccaattttctagtcaatcagaatccaataatatttagatgagttataatctattggaaataaccagggttatatctaaatatatgcttctgaaactttcacaggcattaaaacctagttcaaaacctttaaaatggcacattacaaagtttaaagtcaaagtattcaggaaataaaatgtaggcaaatttgaaatcataaggaaattaattttcatatgtcaaggattttatacatattgtagagaattagtaattaaatcctttaaagttttttgctctgtttcatttttccacatctttgaagaatatctttgaacattattaaaagtgaaatgtgagtgttatttctttaaaatgaatgtagctattttggctaagcactaaatttataaatgatttatgggcatcagatctgcagcttaatttatatactttcattcctttcagcatgttgtccttgactgttattacaaggtcttgaacacactatttcttcataaaatcagaaagttattaggcagactgcagtgattttacgttgagctgtagctgatgagagtgtgacagtgctcaaatgtattcatttatatgctgtaagttgtgtactctagttttccataagtattatttctagaaattgtttgttctgtataattggaaacaaattcaaataaaaatacccttaagataatcacaagctcaataggataatattgtctcattctctatttataactgttccatatgaaaaatgtattattgggaaaaaatcttaaggatgtagtgatacataatgatttgagattatataaaatcctaggcttctattttggaattctgcttttctaagatatttgaattctaaaataaatgaattatgttatttaaaaataaagggatcaaaaatagtattttttaaacataaaaagtaaaattggaaaatttattttatctgataataaaatgtaataaaatatgctatactttacatttatattttacattatttataccatagcaattaatatattttacaggtagtatgtattaatttaatttattgctcagtttaagcatggtattttagctttgcttatgtgtagatggcgattcggtgaaaccctaggtaattaaaatagaaccaacagctatttacatcacaattatattgaaaatattatatagtaagttaataatggcacaaatagagccccaacatttctgtgttgttctctggctgaattttactaagaaaagacacttaagctttgtgtttaccatgcattctcaactgaagagagcaaaatccacttttactaatttcatcaaaaaaccagaaatgtgaaaagatagcaaggaaaatctctttggaagtgactgcaaaattattgaagacaacttaatagtcataagcaccttggtttatcactcaaggaaaacacgttttagtaattagaaaacactttataatttagcctgctgagtgtcatttacttggatacatactcacctttttgaattagcaatgggatataatagtgaggtagtgggagcatttctccacagtgtaggcaatcagggtatacattttctgcagagaatttataaacaataagaaatttactaaaatgtggtcatcttttattatcaccatatcatggcagttctaaagattgacaatgatgaaatacttctccatggaaaagtttttgttctattaagttttacagatttgctaatatgataattgagttttcgttatacacaaacacacacacatttaattacatgtatgtaagcttcaaatcagcacttttcaaaaacttttcttttaataaatggtatattttatgcagaggttaattcaaagaactacctgttacactgtgaacaatgatacatatggattcagctgctatattcattttgagactatgtctgaatttttcaatctagagatttctcttcaaaccctattaacacatacagttctatgtgaaagatttggaaaaaaagaacactgtaaaggggaggaggagatttaatttccttcagttctatcattctttttatccacttggtgattttccttttaatatttaaaacagtgaaataaggtgaagtgtaatggctcatgcctgtaattcaaatgctttgggaggccaatatgggagcattccctgaggtcaggagtttgagaacaacctggcaacataatgagacccccatctttgcaaaaacaaacaaacaaacaagcctggcatggtggtgtttccctgtagtactagctacttgggaggctggggacctgggtagtggagccagctcctatctctaaaaaaacagtgaaatagagtataaacaacaaaatgtgatacttatttgttaagtgaaaatctttgtttatacctaaaatatttcattggaattgaataatatttgaaagctaaattttattatttaaaaattgttcatagtgaaactaataaatcaagaaaatacaattattaactatttgacacaattactactgaaaataattttgctatatagaagcatgaagtgttaaaaaatggtctactcttggaatcagatatgctagaatgctactaattgagggcaaagagaagacatggataaaaacagtgccccccaaaaagtacttatgacatggggaagaatcagcagatcatgtattgcacaaaagaaaacaaaaacaagaaaaccatacaagtaggcacacaatgtgattactcatattaattactcacactggttactgtgatctttacaacttagttcatttattttagagtcaaatcttctaggacgtattcagacagctagtcatttctaattttttaagtgagatgatttttaaaaagtattaggtgccttagaaatatttatttcaaattttaaatatcttgctttttttttcgttgaatgtattctcaaagcaaaacccacaaaaattaagatattaaatgatctggctgggcgcggtgactcatgcctgtaatctcagcactttgggaggccgagacaggcagatcacgaggtcaggagatcaagaccatcctggccaacatggtggaaccctatctctactaaaaatacgaaaatgagctgggtgttgtggtgtgcccctgtaatcccagctacttgggaggctgaggcaggagaatcgcttgaatcaaggaggcagaggttgccgtgagccaagatcacgacactgcactccagcctggcaacagagggagattccatttcaaaaaaagaaaaaaaaaagatattaaatgatctacctttttaatttgtttggcgagtgaaggtagggaaggaaatacacttgtgttttctgtctgtattctctaaagtctgttagatcacaacaatttcttgatgagtagagttcagtagtcattaagaaatttgtgttaaataaaatagctactgataaaaccacaagaaaaattaattttatattatatatttctctaatttggactgttaaaatgatgtgaaaacgcctgcatggacaaagatcaaattttattaatcatccttgttttaaatttttatcaaaatccttggaatgtacttagggcatttgctaggttgaattcagactgagtcacaaccaaaatttgttttaatttcaagtaaacttgaaaaataacacttgtttgaaaaaaaaaaagcaaggtgatttatgaacagaattgatattaacccattggtatgagtgacctattttttaaaaattatgaaaatgaagttcatatgaatgacaatgttaatattaagttattgactttcagactgtgaaactcataagttagttcttaaagatgactttgaatatgacattttatacagtgtttataacatcctgcgaggttcataaaacccatattatattcacatttgctactagggaaacacaggatacctggcaagccctgagcagtcatatactaatacagtggagccaaggctaggatcctattattctgacttctaggaatgaagaatttgcacgtttaagaagcatacacctaggagaatgaagtattttctggactccgtcaataaaaagatcaaatagtaaaaggaggaaaaaagtaacagcctttacaaaatgattgaaacattggaaattcatatcaacatgaaagtattaaagaattatattgtggagaaaaaatatatggagcaatttattattcacattagtgcatgtatattattcaaaactgataggaaaaatacatatttaataatatactaaattaacttttgcctgttcttattccagaaaaatagtaatgcttaatttttctctttatttacactctacaaataacatatttaagaaacgaagctgcattctaggaattcaacttagcagcgaaactaaaataaaaactcatggttatactttataaaaactaaacataaaattggcaagtagcctactttacctaggaatgaaactcagagctgagatgtagagctgagtcaaaaactttggatgttgctactaatgtatttattcaaataaattcatatttaacctttacagtctacaagacagatcccaaacaaaggcaggttttttgtgagggcgaggattccttccctgattaaatcaacctagtactggattgcttcctttctaaaccattcataatatctttgattctgtcgcagtgtcttgtaaggaagagctataaacttttctcaccaaattgagaataaattcttctaactatcagacttagagcacagaaaagagatcatcagatgtttgattcttcctgagccagcacaactaagtgagtaaaagtaaccagtgacgaatttcatggtaccttatagaatgccaatatagttttgatactggaacctttagctgagtggaaaacaagattgattcacagctctaagtggttgtccaattggtctgaaagattgagcctggcttcaaaactaaggaacagctttccgagtggattaatctagcttaaaagatttgaagcaaagtatgccctcaaatggcaagactacagagtttaagtgaaagatgagacttcgtttgagacgctttttttcccccgagtcagggcatatataaattttgtgattcaggattataatttgagtataatgtatattttctattctttcttgtgatagaatgtgttgaaaacttgctctaaaatttgttataattttatttttatatgacaaaaattctttgattgctttgtataatacacaaatattgttaagaaaatgatgtagcttattctcttttgcctaatattgtcaaaaatacagaatattgtcaaagaaaaaaattgaaactgaatcatcattacaattattccttgatgcattattttacgtttgaaaatctggtgagtgttatatttaattatttgtgactatattaaaatttgccttatttcaaacatcagtgctaatatttagcattttgtgtgagatgtaaatattcccagaacctctaattctaaatgaaatgataaatgaaactgaaaacacaatgtatcccaaaatctgccctgctaaagaaaaaaaaaaccataaaatgtatataaattttcttaaactgtcattaaaatgtccaataaattattttaaataatactacaaactacagtatttctttggctatcaactaaaaactgttatgggtgagttatatacatgtttttcatttttaagacgagaagtttttgatcattatttttactatggaggataaggtgaggtaagatttaaaataaaacaccaccttttcagcagaatatgttgaatcaataaaataaatggtaacaattaatagaaaagaaaaaaggcaattttacattgcctgttataaatattccttgttgattacagatttacctcaaaataagatttaggaaactctattgctgctgttctgttcattttctctctaattgctgaatatacttctttgagctgaatggcaaaagtgagcaatttgaaggtcatagaaacaagaatgttggaaaatcagatcaaactcctgaaactacatatgaggaaattaaattcacgacagtacaagagacattaataaagtcactgatacagttaggagcagagtcagggctagtgattttctgacatgtgctagataaatacaggtttatattcattggcaagagctctaattcgtttgttctaaaccattttagtggtgcaatgttctgaaaataacctaaattgagcacaatcatactgaattacctaattagaaaattgataattatatatgcttaaactttttgttctgggaatggactatttaacagcccttttgaagttcatttaatactgctagaaatacctttttattaggtagtataggtttacacgcaatcagatgtttgttgatttctcttagtctatcactgtgaaaggtacactggaggataaaaaaattcataagcaatggatgctgccattacataatagtcaattataaatgagacaaaaaaaatgtatatagagctacactataaacaccgtaaaatgttagagtatgtaatctacaagtgaaaataatttgtgcaacctctgattatgtattattgtattgatcccttttagaatagtttgagcttagtttatgaggttgtgtctcccgaattctatataacctgggctaagaagctctgtaatctgctataaagtgagaagtaagataggttaattgttttgcaacttcatttgcagagcacaatgaatgttgttgtttaaacattaaaataattgaagtttctaaatatgctttctatgtgattaagaaaatttaaatttcaaaatcattattactaatatgaaaagtacaactcattattaaaatgatttggtaagctaatggtggtcacaggaggcaaagcactcaaacaacaaaaactatgccttcacactgccactattcttgcgatgtctttttgttgtttaaaaacagtaagcatgtgtagatccatatatgcataaatagagagataaaagttatcgtgtgttggcagtggagtgagtgttactgtcatgcagggatatgcctaaggaacatgtatcctttttggatcatatcttcagcaggtcctgagaagtgggttttcctgaattagaggacttctaatgctattggagtaatgctcattcataacttcagcaactactattgaaaacagctatgtttaaagttttacagtgcacttaaaatcagacacaaaatatttacgtacagttactcatctgtaggatatcattttgctgggctccccttagttatgtcctattaaaactcacatgttgttctaaggattgagattgggtcttatgtattcctcaaattcatggcttggggagcttatattcaatgacaagaattctaatttgttctaaactatcttagtgatgtaatattctgaaaataatctaaattgagcataatcatactggtttacctaattaggaaacttaaacccaccccttaaaaatcttattaaaataagctctatagaatatttttaaatattataaacgacacaggtcagtgcacttcagagctcagtttcatggccattctctaagatgccatgccagatcagaatttcctttccaaattctctgatatttcaaatgtccagtaaaagatcagtatacaactgagtgtcactttattggcaaatattgattcaaatataacaaagaagacaaccatatgcttagatgggtgaatttcttaaattaattagaaaattacgtatccgattgtcacataatatactaaaattttaaagaatttacaacttatctactgcttctgattaaaatatccagatcctgaattttttggggtaactgggggtaactaggaacctggatattttattttgctaacaaagtctctgtgtatacttttcttttttaaacaatataaattgtgtattccagctataatcttattattggtttatacatgaccttagcaggcaactttttcaagtcatatatatatatggctatatatatatggccatatatatatggctatatatatatggccatatatatatggctatatatatatacacacacacacggctatatatatatatacacatatggctatatatatggctatatatatggctatatatatatggctatatatatatggctatatatatggctatatatacatatggccatatatatatatatatatatatcacctttgcaccgcctatatatatatatatatttgcaattacctttgcaccgcctatttttatatatatatatatatatatatatatatatggccatatatatatataggcggtgcaaaggtaattgcagttttggcaaatggtaacagcaaaaacttcaattacttttgcaccaatctaacagtttttacggggatctctgtagtataaaggggctatcttaaaactattatccggggtcaatttaatttagaaattcctactatgaaatgttagttatttaatatgtgcttttatatttgttaatgcaatggactgacttaaggaaggaactttttaatgatgcaactatattagtgcaaatatttatgtcatctatttagatagtttcttcatgtgttcgtataattgcctatctccctattcctatctgctaatttatgtttttatatttctactcatccccccattaaccgtaagtcaccatatacttcctatataataagtattgcagtagttacaaaagatacaaaacatataagatacatctctgccctaagggaccccacagttatgtgaaagacacaaacgtagataagacaactgaatatctaattttaaaatacaatattaagacttaaggttatttttggaaagtttcctttgagcgtatagccattgaatgtgttaataaaattaagcattaaaatattttctgaaattttaaatatcattttaactttcccaactttatacagttctattcaataggctatagtaaatttaattaacttatagtttaatttgaatgaaatatatactaccaaaatagaagcttctaatagttactctgtaaaatatattgtttgtttcaaaatgatttaaaaacacaaaacagtaatctattgcaaacatagtggccatagttaatgataatttatatttttaacaacccaaattattaatcttcctatttttcaaaaaaatgctaattttaaataagaaacagttttccagtgatgtcaaatcagcctcctttcctagtatgagcaagaaatcgctgatatagaatgattgtatattatgaaatatatactagtataattgcttgacattttctaaactaataaatgataaactttttttctgtaaaattggctttactgacttcagtcttaattccaacataaaaaaaaatgtgtcttcagttggatgatccaaagttatgtttcagcttcaggttgattcaatgtgtgatatgtgaaaatttgttcatactccatggttgggaaaaaaacttctaacttatttgctatacattaacctatagttttggtgaaccatttctactttcaagaacaactaatggcagttttaattaaattcttaaattccagtgtatgaaaatctgtgcaaagaaaaaaattaaatttttatctcaatacagtatagcttagtaatgttctatttacattggattatgtaataaaatagctactttaatgaataaaaatataaagataatctaatatttctcagtaatttattacagtaaaagtgcattctaccattttataagacctaatagtgcaattatttagaaataatgataaattacatagctcattactgagctgctaaaagtgagatcttagaaaatactcagaattattagattaattctaataacttgactttgaaaactttcataaataagtcaatattgattttgtggtcagctttaaaatgactttcctacatctgatccattgggtcattacaagaaaaaattgttaaccacatgatcatgcagtttgtattctgtaagttggctgcctcaaatttctttgctcttttcattttcacatggaaccccagccagaaatgacagccagaggacactcgtccattggttttccaacatcacaagtcatgtcaaaaaacctgcctacagattatgctctttctattcctatccccatcaaaaaagaaagatatattggccatgcaatttcattcacttttaaaggtgtgtttgctctcaacataactattagtagtcatagaaaaagtttaatgtagttaggataataaatattatcataacattacattgtaggtgtttaaatttattggttacatttttctcaggtaaatagcaggggcattctgaataagtaaactcagaaatggaaaagaggtgatttcaggcggatttgcctaaagaaattagaaggatatataaaattaactttgtgacttttttttgctttattttctccattaacctcaaaattgtcctatgagaaacagcatttcttcagtttttaaaaggaaattgaggcttagagatactaaatgatttacccaatgttacccaccttaaatgctagcttctaaaatggaagtttccttgtgctaagtaaaccacctggcaaaaagtagataagagacattaatttttatggtttcaaaggaaaacaaatgtacataattacactcaaacaaacacattctttcccaaaataagattatctaaatatcataatgaaaactagtagtttgaccatgaactctgaattttttatcttctaagtctgttaaactaatgcaaacctcaaattctaaaatgcaaaaaacttttcaaattgaaaactttttgttttgctttctaaatatatgagcaatatatagcaagtgtacttattactcctactttattctgatggttgctattaatgtatttttccaattatagttctttttttgttaattgaaaaatctagcatttaaatccaaggttgctaagtgataagctgagtgaaaactgagacacaaaccataggttaacaagaatttctcttcagagaaaacactatctacttacagtgtatgcaattgattgatatatagaaatttgctgtattcagcataggttaacctcaattgataaacattataataaggattaaaacaaatagcttaattcctcctccaccagtctcatatgatgactggtttgaattaaagatatattttagcagtcaagctgtaggattacagatgaaggaaataataggagcttgcgtatgtgatcacttttctaggcttgaaatatcattaactaattcatttcttgcagttttatttattagttatgcaaatctgcagaaatcacttatttagcaatatttcttagaatgatacttaacaattatgtcagcagggtctggatgtgttgatatattgttcaaaattttctgggatatgtaaggcccactgcaattatcactcactacagttacaccctaaacaatgtatttctagtctgatagaattaaaactttaactatcactatactagcaagtttattacctgatgctgtactattttatattaatttaccggtacatttttcttcatcttctatctacaaggttgttagatgtttatttttatttgtctcataaatcctgagcagtccaatgccaaaacatttttatgttatgtattgtaaatatacaattgacctttgaaaaccacaggtttgaactgaacgaatccacttatatgtggatatttttcaaccaaaggcaggtctaaaatacaatatttgtggaatgcaaaagctgtgtacactgaagccagactcttcagcaggttttataaggctaatttcagaacatgagtatgcacagatttgggtttacacgggagttgggatgatgtgcgggagagtcctgaaagcaatcccctggcatataacaagggacaacagtatatctaatttttattttccccactaatttatgagtactttgaaggtagtctcatcttctttcttcattaagtaatggaatgtactaatgagaatacattttcacaagttcaaatacatatttacaatgttcttatgtgaagtatggtattatttccattatacagtcatgaatctgaggcttgcccattgtcccataaatagaaagcagaatatcagagtttgtctatgtctgtctgaattaaatatctatacacatccttttacattattggcctaactttctttgtgtgtgtagatgtgtgtatgaggggaggggcaaccttcctgtgtacctgttgaccattttgtctgttgagcatttctttgtaatttcttgcactgttcctggggaaagaaagcattagactcaaacttttatatattctgttcttttcctcattaatgtttatttaactttaaatatactacaataataaatcagttgtgtctagagtaaatatcaagtttaattttcaattattttatttttttcagactttgctgtctaaattaattttaagaaagaagttatactaagttataaaagatagcaaatttaaaaaactcagcttaattcagttttcaattgactcaacttatctgtcacacaaacggtttatatgctacataattccagagtagcttactctcctcattcttggccagttgtcttacttcctagacagaaaggctgaaataaaagtccacaattcttttctggttgtaaagcccagatcctgcacactggtgtgctggacagagagtggtcctggctttaccagaatttgctttgagggcctggctaacacaatgttgtagtataggggatttgaagctccatgaagcagcagggaattgggacacagaatgcagtcgacagatactttattctttctcccaccaatagatagtctgagattcaatagtttcatgttgctttgttgaaaatgccctacaagactttgtatattgctgttactaatgaaattatgctgtatattaaaccatccctaagacatcgtatttcataaccaccaccatttaattttactgaaacatctctaggacagactgggtttgactgttgtagataattttagccagagttgctcattgctatgggtttacatcggatctgctcaagtttttctcatttatctgggactaacaggtagcttgatgggcaatagagaagcctaaacccacaagcacatttaaagtctctgcttgcatcatctagtagtattccaatggccaaaggaaatcatatgtcccagcttcattaaacaccttttttttttttttgagatggagtcttgctctgtcacccaggctagagtgcagtggcacaatcatggctcactgcaacctctgcctcccaggttcaagagattcccctgcctcagcctctcaagtagctgggactacaggcacacaccaccacacctggctaattttttgtatttttagtagacacggggtttcaccatattggccaggatggtctcgatctcctgacctcgtgatccgcccacctcggcctcccaaagtgctaggattacttaaaggcgtgagccactgtgcccggcctaaaaaccttttctttctttctttttttttctttcttttctcttctttacttccttctttccctcacccatatttctttgaaattgcatccaataaaacattagtacaaaagcatttgctttagaatctattttctgatgattatgaactaaaagtgttggtatcaggaattacaaagagacttcaggatgggatttgggatttggattctatatgacaatataagggcagacaggcatcccataatgactgataaggaggctcatgaaaccaccagtaggcagtggcatcacaattaggaatactttcatttgtacttcacattcctcacctaaacccaggccctatggcttggatcactattctaggcaatcagttagattagacagtgctggatgaggatgaagaaaaattaaaaagttggtgaagggaatagattatgaaaacaagttgtaaccaagggaccagccgttgtatcaagtcttttaagacattgccactttccgcctcttcatctcttcttgaagaagtgagaaaacgttattgagatcaggttattatgagacacttgagtgaataaaaatgatgcaaggactgtactggatttagttcatgtgacatttcagattgtcagtcttgcctaattcccctctgaatcttagcaactttctctgctggtcctagggagagcttgcatttttcttggaattataaagtctatgctgctgcatctcccatcaaaattgtcactaaagtctccatgtgcacatatggttacaaagagagattggtgtacacacatactggctaagctctgtacccagaggtgttggcttccccagggcctgagttgagaggctagatgagctagatgagataacccaaaagcacaggagagttggtatgctgttggatgaacagtcctgtgggagatggaagtaagagggaggcaaagatgaatagcttgtgcatcttccacatgtattccaactgaatattctaagatgcaatggtttcaaagtctgtctaaatattatcgggggaatgagcaatcagtaacattatttcatagttgtgacaagtgtagtaagaaatctcctttattgccctttcttcactttttcttcacttcctattttccctcacttcttcactaggaatctctcttcttctacctcaataaaaaaaatagtatgaaagtttctttgtctcaaattattttttctaggaaacatggcaaagataaaatttaatcatgatgtatttttacaatttcacattctctccaccacttttatgatatgttgataaataaaaaataaataaggtaatgaacattattggtggaaaaacaaccttataagcaaagtactcccactcttcccagcagcgtatgatgttgctgctctattaatttcagtgtttagattatgcagaatgagcctccagcagaccattacctggcaacagctagaaatgcaaacacattgctaattgcagattactttccccagccaatcagaaacaacataatcataagctatcaggtacagacatagtaatgcgaatatctgcgaatactactttccaagaaaatctgaattgctgcactggagaatgttatttggctgaaaagaaggtaaccattgcttatttcaaagtacagcatgtcctctgacacacataaaataggatgttaaaaacaataataatgaaatgacttcagtaagctggccctctagttgcaccatgtgacagaaatcccattaacttaaaagggaagattttcatctttcacacctgaactctggaagtaataaagtaggcgtgcaatttctggcacaacacctcttttttatacactgttatagaaacattttggaagtgaggagaaatagctaatcgctaaagaatttaacattttgcatcaaaagtccaggaaggaaaattagaagttttagaaattagacttcagaattcgtatgtttatgatgtgtgtagagatttggtaacatgagaaaggtggcattaaaaatattctgtcttcatgtttgtgctctgtgtaacatgcctctgcaatctaaagtgcttacatcttgaaagtttagatttagaaaaaaaaaagcacaaattacttagcataataagcaaagacatatattgattgtttattgtgttaagcactttatatgaaatatctcactgaatatatccagagatctataagagtggtaataaataccattatccctatataatttataaagtatctaaaacttgtagcatttttgttatttgctgtttcataactagtaactgccagagctggaactcaattccaatgttgttggattccagagtttatgttctgtgaattggatttacaataacatttttgataatcatctcgctcactagaatcagggtgagctttttttctctgtattttaaaattcaagcttttgccagccccaaacacctacatgtcttgtcttctctgcctgaaatgctttgtccacaacatctgcatgactagctaatcattcaggtgtcactaaaaaaaaaaaaaaaaaaaaactttgctgaagagctttccctgatcaacccatctgcaacatttatccttctctttcactttctatagcaccatcctattttattgtccaccttaataccattggaatttatattgttaatttgcctgatttcttgcttttttttttttggtctccaccagggtaaaatagcagggaccttgggtttcttattcattactgatttctcatgacctgtaaaacattcagtaggtcatcaataattatctattaaatgaataaaggcatattgtgttaggaacacattgtggttccaaaccattctgtattttaaacattaggcataacttcaaataacaacaaaaagcaactgtttgttagtgtaaacagcacaaactcattagttacaaagatataacattagaatcacagattttctaactaccaggtattctcattcttcatttcttgaattaatagtctttctcattctcaagagccttatcaactgtacagatatatcaccccctcaacacacatatattctactaaaactacctttctcgaaagtcacaaattagtgcttaatcactagaacaacatcccctgtgcacttaatgttttttaccttttttcccagaaagctgccatacatgcattctttttttttcaccttccttaacttgacgatcctctgactttcctgctatctgtccactcattttcaccacctgactcccctttttcctcatgaacatatcgtatgtgacaatttcacagagttttgaaattggcatttcagactcactgcaaatttagtcattgcaattacattatgttctatatactatgttagatgttaagaaaacagtgataaaactaaatcttgatgtgaagccttggaaagattgaaaatgagtctgagttccaggcatggacaaatggtcatatgctgttcccattcgttaaaataagaattgtaggagatatacagtagtttttgaacattctgagcttaaaatttttcttttgttttgttttgttttgtttttcagacagagtctcattctgtcgcccaggctgaagtgcagtggcacatcttggctcactgcaacctctgcctcccaggttcaagtgattctcctgcctcagcctcccgagtagctgggattacaggtgcccgccaccatgccctgctgatttttgtatttttagtagagacgaggtttcaccatgttggccaggctggtctcaaactcctgacctaggtgaactgcccacgagagcctcccaaagtactgggattacaggcgtgagccaccatgcccggcctttgagcttaaaacttctatgcaatgttctaagagatgtgtctatggtagctaagtgactactagattgcctttcattaaaatattgaagaaagttgtgctaattgagtaagtgtgtatatgtgtgtgtacatatatacatttaaacattaagcatacatgtatgcatgagtatataaattcatatgtgtatatatacatacagacacatatttgtacatatatgtatgtatatacatacatgcacacatatatacatatattacatatatttagttgtatacacacatgtagacacaatacagagttttattataagtctaggtttactttatgggaatttgaatcacagatttgacatggtgaaatataaatattatctcatgttatgcaaaaaattatgaaaaaataaaatatttataatcagtggagctgagtgaattaaaaactgtagttggagaaatactgaggttattaaataaaatctactgaatttcttaataatcagactatttcttatagtttttctaagaactgatactttttcacatggttgtagtaaaattaacctctgtagaatgtactgttgcaacagcatttgaacagtcattgtgtggtggaaccaatgatataattaaaaaggtgcctaaatttaaccttgaataaaaagtataaaacaatattataatgtacatttttatacgtattatttataagaaaaataaattatatacatgtgcacacagattatgtgtttgttatttttataaaatgagtcaatttatgtataaaaattttgatgtgcctgatgttccttaaattcttaagaaggcttttggagataaaatataactcttagtttcaagataaaattaatcaatccaatctgtatttattgtaaaaatatctgttctgcctcttttattttggaaactttaatcttggaaatgaagttcactgggtgacttaatggtatagcatcaagagtgagtgttccaggacagatagatagctggttactgaagtgccataattccaaagcacactcatctgtctaaatatggttcctagctgagccactgtttatatatagatagagttggaagtacatatggaagccaagaatcctacagtaaaacaatgacagaaagagacatactatatatcataaagtttgtttacttctatttactaaactttatggacttcacatttcaaacaaagaaaacttcaaattaggaaactgagtcataacatacattaaatggataaagtattaccagcaatgtctcttcacactctttaaatcaaaacagcccccttgacttccttaaaagactgcctatgtcaccagtaaaggtgtccaattatagccaaaagtaactcaaattagaaaagtatttgcctacccttcagagaatatcaggactaattacttcatggactaagtcttgtttacctccatttccataagaaatccaacttcacatggtgttattcatcagttgaccctctgcatcatgtctctccacttccccagtatgatccaatcacctacacctcttttgagctctagccttcactgcattgtgcagattttgtgctctgtcatcagcatatccccaaatacttaaacatctctttagtcatgccatccttttcttgttcaaaatgaaacctgtttttttcattattagtcttctcttatgccacaggtaccacagggcctggaggcggaatgggtgatctttctgttcttcatcgccctttcagacatttgtctcccgcttcactcccaagttctttgatggtaacagctttttcatgctattattatcactaactgcctaatcttaaaacttttttactggatgccacccctcatttctgaaataatgatccatgttccatcagtacaatcaatggtgtctatacatgttcaacaccgtttccttattctctcacttttcaactttcttggcaaagccacaactcttgttaatccaattttctatattattttatcttctgaaagaaggagcacacaccatgtttgatgacttcatttcacagctgcctctacaaacagcggattttcaatatggctgtggcaaatctacagtattttttctacatgctttaccactcttagaaaagattgtttcatgttatctcatgctaaactttcaaaatatgcttttatttttagttgacaatattgattatttcatataaagataaaaggaataagatactttgtctcataatactttatcttgcccagatctcatcaaaatctaacatttacatttataccacagtgcaagttcttacttcgccaaagattttcttccgacagttagaccctctttcttgccttcagagttttgcttttcactgttgatgactctctttagaataaaaactacgtgcaatatagtcaatctaaaaaaagtttaaaaatgctaaatgagacttctgttttggggaagatagatgaaataccctatttttccatattttctctgctacatacaactagataccttggtcttcatatataaaacaaacgagaagatttggaaaggtggaaagaggaagacagactggataagaacacaggactcaagaaatgacataataatgtactccctgggtactttttttttttttttacttacatatgttttatttggatgtgaagaagtagaaaaaaaacaggaagtccaataggtacagacaataaaagctaaaacctaagcctgctttctgtagccaaaggactggcaaaagggcaacctagacagataacaaactttaagaaagtaaatgacctactccatccaaacaccacagagaaaatggtggtctcaccttcttccacacaaataaaggcttaatggggagcttagatttccaccctctgagggctataacaaggcaccattaccctgccatttggttgatacagtgaatacttaattgaaaagctaagattttcattttttctcagtggtagtaagacactgctagagtcagtggagatcatgcagacaagacagacttgcaggtgcacccagcagtaaacaggctcccctctgcttcctacttggttgtgtcacagaaggtctagtggagagtaagaatttttactctgtctagcagtaatgagaccactcttctgccatattgtcggtggaagtcatgtgagaagcacctgcaagggacatctaattctcccagacaggcaggtgtctgtggagagctaatggaatccaggagtcccagccacactcctcagtacagaaaagccctctttcttctcaggcatcaacagataataagtgacaaatatggctgtgccccgtcccacttccctggccaaagaagtgtcaaaagaagacagacaaaacataaggcttaaataagatccagagtttcattacagaatactcaaaatatccacagcacaataaaaaaattactcatcatacaaagaattaagaagatttgtaactgaatgagaaaacacaacagatgttaacactaaggtgacagaaattttataattaattgacaaaaattttaaactagccatcataaaaatgcttcaatgtgcaattaaaaagacacttgaaacaaatgataaaataagtcctagcaaaaaaaaatcagcaaaaaatgattgcatcagcaatagatgtaaagagtaactaaatgaaaatttaataaatgaaaaatgtaataaacaatttaaaataaatacctcaaacatttggctcaaaaacaaaaaaactgaaataggcaaacagaagaaaaaaaatcagtgaatggaaagctgaacaatagaaatttctcttcctgggctacagagagcaaattcattgaaaaataagttaagagagcctcaaggacctgtggaattataatacaagatgtaatattcatgttattgatgagaggaaagaagaaaaagggatgggatatacatttttcaaaattaataagtaaaaacttgtgtaatttggcaaaaggcataaaactatagatttagaaagatgagtgaatcccaaacaaggaaaaaatagaaaccccacaccaagatacattatataatgcttctaaaaacaaaacaaatttgaaaccactgacagagaatttttttcatataatatagagaagaaccaattagaatagcagtgaattttttatcagaaattatgaaggccagaaacaagtctcataatatttttcaactgctgaaaagaaaataacatttcatgatgatttctctacccaagaacatacacttcagaaatgaagggggaaattaagacatttttcagataaaggaaaacaaaaagaatttgttgccgatgagactactttaaaggaaaggctaaaaaaagtgctctacacagaaaggaaataataaaagacggactcttagaccatcaagaaagaagaaaaaacatgataagcaaaaataggggttaaaaaaatagatcttccctttactcttgagtttgataaattatgtttaatggttgaaaaaaacactatttgatatagttttaaataaatgtagcataaattcttttattttattattattatactttaagttttagggtacatgtgcacaatgtgcaggttagttacataaaaatttttaagacaactattttataaacctaaaattataaaaggtcaaaaagtaaagtaaggtttatatacttccttcaaactaataaaatgattataccagtaacctgtggtaaagtgtgaatatataatgtagtacctatagcaaccactaaaaaagctatgcaaagagatatattcaaaaattctacagaagaatcaaaatgcaatgtttaaaaaagttcaagcaacccacaggagagcagaaaaaagaaaacagagaaagagaagaaaactgcagaacaaacaaaacaaaatgcaaaaggccaaatataagccctaacataacaaaaattatatataggtaattaacttaaatacagaaaaagcagagattaacagattacaaaccaactatatgctgtctataagaaactcacttaaaatgtaagtatataggtgaggtgaaagtagaagaatgaaaaatattgaaaatgttattcagctaaaattagggatgggaatattattaggagattaagtaaagtgcagagcaaagaaaattcagagagaaagtgagagaatatgtaaagatgaaagggtaaatccaccaagaatacatagctattctaaatgtgtatgctcctaacaataggctgtaaattatgtgaaacaaaaatgacataaatgaaaaaacagacaaaaattatagctgaagacttcaagacctgcttctgaccttgatagaaaaactagaatgaaaatcagcaaggatagataattcaaaaacacattaaccaacagattctaattaatatctataaaacactccaaccaacaacaacgaaatacacagtcttttaacatgcctttagaatacaaagaaagaccatatttggggcttacaataagccacaaaagctttaatatatttaaaatcatacagaatgtgttcctcaagcacaatgagagtaaactggaaatgaataacaaaacaataacaagaaaatttcccaatacttggaaactaaacacacttctaacccgtcttctaaataggaaggctgagggaaacaacaatatcaagacaaacactgagacggtgtctcatcttacaccagtcataatggctaagagatctaaaaataatagatattggtgaggatgtggagagtaagaaatatacactgttggtgggaatgtaaattagtacaacctttatggaaaatagtatggagatagtcaaagaactaagaacagaactgttatttgatccagccatcccactactgaatataaataaatcttatcaaaaatatacctgtacttacttgtctattgcagcactattaaaatagcaaagatatggaatgaaccaagtatctgtcaaaagaggattggataaagaaatgttacatatatacgtcacatgatgaaatactactcagccaaaaaaaggaataaaattatgtctttggcagcaacatggattgaaatggaggccaatatcctcagataactcagaaagttaaatactgcatgttcttctttggaagtgagtgctaaacaatgagtacacatgcgcatacaaagtggaataacaaatatcagagactacaaaatgtgggagggtcaggggagtgagggttgaaaaattatctattgtgtacaatgttcactatttgagtgataggtacactaaaagcccagacttcaccacaatgcaatatacacgtgaaagaaatcacatgtgtacttctaaatatgtttaaaaataaataaataacataatgtaacattgaactgcatgtaaatatgaataaactatatcaccgtttgtaggacagagaagtgctaggaggaaaatttatagtactggtaaagataagaaacttcaaatcaaccgtgtaagtttctttctacctcaagaactttgaaaaagaagaatcaaataaacctaaagcagtcagaaggcaggaaataaatcataaagtaaattataacgataacagagaaaaatcaaagagattgtaaacaaaatatcaaaaaaggaaattaatgaaacaaagaagtgcttctttgcaaagatcaatgtaattgacaaaaccacaaaagtagtaaagaaaaattggcaagaaacaaattgcaatattaggaataaaacaaaatataagtacagacactgtagattcataaagggtaaaaagaatattataatcaactgtatacacaaatatttgccaatgatagtgaaatagaccaattcctccaaaaacttaaaccatcacaacatatacaatataaaatagataatttgaatagctcaataactacaaagagaattgaattcaaaaaaattacaaaatccccgaaaaggacatctccaggcctggttgatttcactggagaattctaccaaatattcaagaaaaaatattatcggttctgcacaatcttttagagttttagaagaagggaatacacttttcaattaattttgtgaaaccatatatgaaagccagaaaacataacacaagaatgaaactagagatcaataccctcataagtagagacacaaaaatatttgtaaaatattagcaaataacatccaatatcatataaaaagaattaaacaccatatagggtttttccatgctggtttaatatttaagatataatcagtgcaacgctatattctcaggctaacaaagaaacagagaaaaatcacttaattacattaatatattttctatattttaatgtattaccatatttctacagtgtggagaaagcatttgagaaactctgacatctgttcatgattaaaaacttcagtagaacatttttaaaacttgataaagaatatatacaataatcttcaactcacatactcaatgatgaaagactgtatacctgcatactttgctactaaggtcaagaataaggcaaagatgtccatttttatcactcttattcaacatagtactagaatttctagctatgcaataaattgagaaaaggacacagaaatcatataacttagagaggaagaaagaaagctatatgtatttacaaatggcatactctttaatgtagaaaatcttacagagtctatcaaaaatttctagaactattgagttcagctatattacagaatataagatcaatgtacaaaaataaaatatatttctaaatattagcaatgaatacatggaaacaaaaattaataatacaatatcatttttaattgttcaagaaattgaaatgcttaggtttccacatctgtacaacacatgtatagaaatttatggttaaaaaaaatactaatgaaatggggatgtagtatggtcatgaattggaagactgaaaatcctaagaatgtcaatttcttttttcccaaatgatatagaggcttaatgcaattcctatgaaaattttagatttgttaaaattttgaccttttctagagatatatgaggttaccctaaaatgtatatgaaaaggaaaacaaattaggatagctaaaattattttgtaaaatatgaagaaagtgagaggaattaatctatgtgatttcaagacttagtaatcaacactgtggtactggcagacagataaaaacacagaccaatggaacaaaataaagaactcccaaatatactcacacaattatgcctcactgactttttccaaaggtgcaaaagtaataaaatggaggaaatacagaactttcaacaaacgttactggagcgattggacagctgtaggccaaaaaaagaaaacaaacaaacattggcctaaacctcacaccttgtacaaaagtaagcataaataaatcataaacaaatataaaatctgaaattataaaacttttagaaaaaatgtatgagaaaaatcttctggatcaaggctaggcaaaaagtttctagatttggcaccagaaacatgatttatagaaggaaaaatctacatattggatttcatcaaaattaaaaagatcactgtgaaatacactgttaagaggaagaaaagacaagccacagaccggtagaaagtagtcgcaaagtgcttacctgacaaagaactagtatctagaatacatgaagttttaaaattcaaactaccaacacagttagaaaatgggcaatggacaaaagccatgtagatatgtagagacattttagtgaagaagatatacagatggtaaatagtacgtgaaaagatgttcaacatcattagctattaggaaaacacaaattaaatccacaatgagatattactgcgtacctattagaatggctaaaatacaatgtggtgacaagatcaaatactggtgaaaatttggagaaactggatgacttgcacatttccgatggggatgtaaaattgtacaattactctagaaaagagtttggcagtctctcataaaactaactatgcgatcaccacatgacccagccatttcactctttgacactgttgaacccagaggaagtaaaacttattttctcctaaaatcttggagaaaaaatattcatagcatctttactgcaataaccaaaaactggaaacactcacccaatatgttatttaataggtgaatgttcagcaaactgtaagatatattcataccacagaaagctattcagcaagaagaaacagcctattgataaatacaacaatgcaaataattcttaagggaattatgataagtggaaaagccagccccacaaaattgcatgctttatgattgatttatgtaatattcatgtactcacaaaattatagaaatacagagtacagagtattggtactagacgttaaggagggtgactgaagggaatggctataaaagggcaacatgaggaaatgtttatggagatgaaaatattctgttacttgattgtgtcaatgtcagtgtttggttataataatgtcttgcaaaaactagggttttgcaagatgtttccagtgggggaaagtggctaaagaatacataggctctctttgcattatttccactgaatgtgaatttataattatttcataataaaagttttaatgaaaaaataaacaaaaggtaaaaccacagcaacgaaaacactttgagaaccttacattttgatccagctactggtttcatttctctttcataacaatttcaaaagacttttttacagtcatagatcttgcttatgtttccatatgactcttaaacaacgaaccctaaggagggtttattcctttcactctcctgaaatggcaatcttaaagattccagtgatccctgtctcaccaaattgaatgatcaattccactccatcatttgattcaaactaaatagcagaaacttacacagttatttactcttcacttcctgaaatattatatttccttgccttaaaagataccaactcttgctatccttttacttcatggcacctgctactcaatcctactactcaatctttctggcagatttgtccttccttttatgaccccattggaatactccagagcatttacatcatattagtttttcacagaaaatattttgtaacacacaatacataaaacaattcacatgtctgtgaataataagttggttaactatattagggtatacgtgtgtgatgtaatacactaaatgatacatgtaataagtgaggatacattttaaatttaatttttttaccatttttaaagtgtacagttcaatagtgttaagtacattcactttgttgtgcaacagatctctagaaatttttatgtgtaaaactgaagcttgtactcattaaacagctccccatttcccactctgccaagatccttgtaaccccctttccactttctgtttctattaatttgaccattataggtaaaactcacaaaattgccctcttgtacctccaccaccaccttgcttaggttcacttggagttgttttcctttcccccacatttatttttaaattgacgtgtaaaattgtatgtacttatcatgtaggcttgtctaccctgaacctctagcaacacatcagttacagttcaggttttcctaccctgacactggttcctctgaattttggctcagggctttctgctttagtaagttgtgattctgtgtccatctgtctgtctctccagttttatggggagtagaccccacttttctgccagatcaagtagagctgttgatttttgattttgcttagcttttgatttgttgttaggatggaggtaggacatgtgggttcttcttatgccagaccagaaactagaagggcacaaaagtgtttgtttgatgtagtaccatttgtctgttttttgttctttcttctgtgctgttggtatcatattgaagaaatcattgccaaatccaatgtcttaaaatttccccccatctattttaataagacttttatagctcggggtcttatgtttaggtctttaatccattttaagctaatttttgcgatggcctaagaagacagggttcccctgctccaacacctcctgccagggactattactgggaggcccagcaggaggtgagcatcagatgagcaagcattaccttaccacctgagcttggcttcctgtcagatcagcagcctgcattagattctcacaggggcaggaaccctattgtgaactgtgactgcaagggatctaggtagttatgtgctccttatgagaatctaatgcctgatgattggaggtagaacagtttcattccaaaaccatcccccttctgcccctacactcagtgcaaaaattgtcctccactgaactggtcccttgtaccaaaaagggtggggaccgctggcataggataaggatgtaactccattctttcgcatgttgacaaagttttccaaacatcatttgttgaaaagataattgagtatatttttatttctaaatattgaaagatctggaataaatgaaagcaatgcaaataatgtattgctaatatttgagtttcaatataaatatttatctttaaatgaataaaatgtctctataaatataatatgttctattatttttcagaggaaggagctaagtgactgacagacaccgacacataagaaaaacttatgattggcaaaataatttttgcaccatttcaacgtgttaacaaacaactctttaaaaatgataaatgaaatacaatgttttcttttctgattagttcttttcttttcttttttttttctagaacagttttcttgcctcatctcagtttttaatgtccctgatgtctcagagaatttaaagcttttgacagcaagagatgaatcatattaatttctatatgcactgaataagaagaaactcaagcttttcattacctgaagcaattcaatggattttattaaacaaacagttatttttgactcaaattattttataaagtcattcaataattcttgcaaataaaataaaaatgaacatcagctcagtgaattgttatagaaaatgattctgtttttttagaaatatggctacaagtagaaaatgcatctagaatctttaattgatcatacattttttatggatatagagacagatgagaatatattgcataattataaattctattgccaaactacaaatcacataaaatagctacaattagatgatgaatttgattgttatctggtgaattgagcaactcaatgatagtaattaaataacatggtaggaaggcaaatgcatcttatttgcccctcccatcctctcctattcaaaagcctttctaacactgctttcaaggcactaaatcaaattaatatttcaggacacaactcttcctactgtggggtccccatgccttctaaggtaatacacttaagtgtgtgttccaagatattaaatcctgtgtaacctctactaaaatgcttcagagctcaaaattgatgtcaaatgttaatcaaaaccttttggcaagtatagaattttaatggaattgcttggttcttggattaaagcagaattttagtctctgaaatatagggcaaaaccttggcatattagatatacactctcctgcattcattaagaaagggctatcaggaatgctgctcatacaagctagcagcattaagtacataggtttgaacattaaccttatcatttcatgaatctaattgatttgactgtcttggcctttgacaacgaaaacatacagcagggattcccatcaattttactcatctatctttcttttaaaacatgtcttcacctatcttagctaattttatctagacttgttcagaactccagaaaatgggcttacttaatattattcctttgcttctcattttctccctctcattttcatatacaggtagtagaaaaacttttttatgttatataaaaggaaaaataatttgatctctgaagtcttttaccgagattaggaacaaggaaaaactggctcttcaggttcttggatggagtttgaatagtataccctcagccactcgactgtttattaattattatgattaatttcttgggagaaacatattgtcaacctcgagaaaagaaaaaatatatatactacttttctaatgaaagaatagatattttgaagtgtcaaaaatagagcatttgcctcttataattcattttttaagaaaaaatgtatttctatatgaaaacagttgtccattatctaaccaactatagccctaaaaatgaggaaacatgagtgtctaagtagggctcaccgaggacgtaaatgataaagttgattgctaggagcttgaggcaaattcagcattgtcagtcacaatattttctgaaatcatttgtatgctatgtatattcacatatattaatatttctgtctcccttcatatttgcttcaaaaatatatttaaaacaacacagaaagcaggaaaataaaaaaccagaaattagacttgttttactgtacctttttaatcaggatataatctaaataacattgtacaattattggcatgagccatatttagagctgtgcatagtatagcaaggacttcattttatgccatttaaaaatcaccctttgtatttatgctcatatttagattattttatatttatataaatataaatataaagttaagttttttcaaaaatactaagaaaatatttcctagaggcagaaaatgggtgaaaaaataagacttttctgcacatctctcaattccagtatttactgcagatttctttttggctttttagccgaacaaataatttgatttagaatattaactttatcaacgacaaaattcaaactatagttttcttttctgtactgtctttgctaagttttgttatcgaggtcatgctagtttccaaactaatttggaagtataaccttttaagtaatttatcaaaattatttaaactgcatagttcatgaagtgtaaggaatttagttctggaagaaaaacaatgttttaaactttggtttgctgcttaacataaaagtgagtaggttattttggttttgattcaaagttctcttgtctacattgcgtagataataatatacttctcatccaaacattttgggttattgtcataaataaacgagatatcctaggttaactgactaacatgagttgaacttttcctaattcttaaaataagttttagacattagcatagtgcataatctacagttaaatctctgtaatcatttttgacattaagctcatggaatattattctctatcttattgcctgtgagtaatttgatttttttttttttttttttttttttttttttttgacacagagtcttactctgtcgcccaggctggaatgcagtagcgcaatctcagctcactgaaagctccgcctcccaggttcacgccattctcctgcctcagcctcccgagtagctgggactacaggcgtcagtcaccacgcccggctaattttttttgtatttttagtagagacggggtttcaccatgttagccaggatggtctcgatctcctgacctcataatccgcccaccttggcctcccaaagtgctgggattacaggcctgagagtaatttaattttgaataaaattaacttttatcttttctggatacaggattatgataattaaaaaggttttaaagcaaaggtgatgattatatacttgaatattctctgaatatttatggtaaatttagtttataaacattttgattgaaaaatacaatagacaaataaaagaccgtattaaatgtgaatgtggagtatagtgaatggttataaagactatgtaacctagaccattttaggtctagtgagtctctattaagaaacatctataccccttcatagatataacctctttcaaagttataatcaatttttatacgtttcctatttatatttattttgtctgtcgaaaattttcattaatgtatacattttctattttcatcattttagtcttcccaatcttacatcgtttacttttttgtttaatttttgtctccaatatatgtcttgtcttttaaaaaattatctcattttgatttatttcttctttctctttgaggatttgtctttttttttcaaactcttgagatgaatatttgaatcattagattttagctcttcttctacaatataacataagcatttaatgctataaattttttagaacatctcactatattaggattctagaagttttgctatgtaccatttttattaatattctaatacattattctatacaatatattatattatatattctgatatatattctaatatattatatataagatacatatagctaatatatataatatattagaatatattctaatattctaatttatgtttttcttaatctttgaataatgggttatttatctataactggtagtatgcatgcactagaaatttaaaatataattttggagtagtaagtttattgattttataacataaatgtgtttgtccagaaaatgcacattatatgatatgtgatttcaatgatttgaaatttgctaatatttccttaaaacttcatagtttttctagttgaattttataaatattctttttaagctaaaaaaaaaagtgtgccccgcacttgttggaaacagtgtcgtgttgtatcctatttaggtcttgtttgttaacttgtttaaggcttctgtgtatctctactttttttttctttgtccatttgttctatcagttagtaagaggagtgtgttaacattctccactctatggattttgtaatttcctagttttattgctgcagttttccatgttttgctgtttgtgcctatgttgttgcatgcagcatgtatttgtgaagaatcagagaaagagaaagggaaagagataatatgtcattaagtgatacaaatttagaatgattatatctctccctataattgaaacttgtgtatacattagcttcagtaatgctctttggcttgatgtgtattttgtttgctcttaatataactaagtaaacatgctgttaattagttttttattgacaatattttgattcttatatatttagggaaatatatctttactattttttacgtactactttggtaacttgtaaattggactttgtttcatgagtctgattaacttcttttcaatataagaatataacatttaacataaccagtcatatattagtgtctaaattcagtattcgtgtgtgtgtgtgtgtgtgtgtgtgtgtgtgttttgtgccatctggtttttacccatctcttatatcagatattattaattttaatcttctaatgattaacatagaatttagagcatgaatcattatccaaaggaatgacataactcagtacccttttgacaatatgagaactttagaggagtttaaatcctgactatttgtatattttaattatatttggttttaaagtgataatattattattgttttacatagtcatatttatcttgctttattaattttataagccagaataatcaggagtgattttatctcctggaggcatgtggaaatgtctgcagctatatttagcttcaatcgggtggatgggtgtggatgctactgatatctgacatccagtgaatagaggcccaaaaaatgccaaacaatgctgtaacacattggacagccctcaccccagaacaaggaattctccaggccaaacatagactgcttaagttgagaaatcttgagctagataatgctgagattcaaaataaaaaggcacataattgtctacttatcattcacaccataggttgctaaattggagtcaccttctctaatcccccaggttcaagatgtagtctataatattactgactgccatgtcggagacaaaggtagttctggagcatcttgcattatccatcaaatatttggtctaagaaaagcatgtgccatttttgctcaccgtttactacctattactaatcaggtggcctcactccataaaaaaagcctaataaatacactcctgctatgtcctgaggatttagagaggcagatataatcaaggtgcagcactaatagaataatgatccaccacaattagtccttgtggtcaccaaatatttggccctctctccctcccttaaggaaatataaccacttacctggaaaaacagataaatccaatactcagttcagtcacaatatgatcttaaagacaatatctccacataactcactgtaatttttaagtaaggtgtaattcatggtggtctgtatatgatatctggatgttactcctctaatgtcataaaaagatgatttattctcataaaatgttctagaaatatcacaaggcaggaaaaggaaaactaaaacaaacattcctatttataggggtaagaaaaagagactcattgaaattactgaactgcaacaattctgaatcttagagtgcaatgtctgaaggctcgctgcctggggaatggggaatgtgctgtgtttgttaattccatcatctttataattcttggtgctatttctattagctgagtgtattaatcattatgtataatattagtctgcttctttgcacatctgataatttttgattggcttccaatcaaaattaattgtagtttatattaacatgcattctgattcattgattttgtttttagctttttctttcctgcttttaaacccattcattaaatttctaacattggtacttgaattattgaatgtttatacaatatccaaccatctttttgctagtcaactctattacttttcataatttctttctagctcatctttcttaaaatatcataaacatagtaattttataatttttgcttaataatcaaaagttgcaaaactatgagtttttttctgtggtttattatttctgctaatcttgcttatggagaaatattctgtgtatagctgtttttcttttcctatgtgctaatttcctaaaacattattattaatataaaattaaggatattaattatggtatattagtccagaggggttctaagtttctgacagtctcctgaagataatttactgagtataattctttactggaactatgacaaactgttttgaggcttaagatttcctgaatgactgaggtaataaaaaaagtgacagcttttttccactccaggattggtacattttcagttatttgacccttgatttaacgatgtagtcctctgtgcatgtttttgtgttgcaaagaagactcacattttagaatctttttttcatcctgggttatgagataatttacaagcagaatttgaatttcttcatacctgcaaacacagggaaaaaccatcaattttactttttatttgtctcagttatgtgtgctgtttagttttagtccagacataactttagttgaatgattttataacaaacatacatttttgagtttttatatttttggtctgaaatatttagcttgctatttttgaaacaagaagtgtaaaatgtatttttatttactctttttgatatatctctatttataaatattttagcattcagcaacctttctaaatgtttcaatacatgtactatctattaaatgtgtatgtatttcaacataaagtcaaatatacagtaatctgacttttaagataaagtaataaaagaaattatggttttacacaatggaattatgtaacatataattttataagaaagataaatacaagaattaatatttctttggatattgtatttgacagtatccaagaagaggtagactccaattagcaagaaaataatctccttaaaagtttttttattttgaaataaatttagggtgggttagaggctgattcttgtagaatcagctatgtggtcattcaccctgtggatgatcctcaaaattttcaaggtcataaaatattcaagatctctgaaaataattgcacaatacattgcttagttgacatgggatgcagtatttctgtttaaaagaatttgaacccagaccacagttgagattcagatacatacagacttgtcatatatatcaacatctgcaaatgggggagaaaattgtggggggaggagacgctgagaaaattgcatcaagctgagtattaaagcctacatattaaagagaaaattgacctaaaaaataatatcatcctgctttgatcatctcaaagtcagacctccattgaatccctgtaaagtatggcagagaaaaagaagatttatataactatgctaagggaagtccctcataaaaataatgaaagaatctttcctactgacagtacaaaatatgacaaaggttagtaatgtcatatgaacaagtcagttggtgacaacgggtgggaagcatagtgactggtattaattaagcaaggtcatatgagcagtaaatacccaaggatatgaacttaaagcacatcagcctctgatgacatgtgagaactgcatcaatccttttataaaatcctggtgcgaataattacagttagagaataagatatgatgactgagcatcttaatagtaaaacaggcacagtgtcataatcttgacctctgaagtattgctgtaaaaataataaatttgtatttacattaattatgtgaagcaacatatattaatctaaattaggtcactcaacaaagattttcagaaagtccttgatcaaaattatatatatgcataaaatgttaatgttaaaagagagtttcatactaaaattgtaagctgatattgctgaactgaatccagacaatttaaaaataataaaaaggaaagaaaatgaatgtttaaaaaagaagaaaaaagcataaatgtgaagtttctgtattaggagaggagggtcaatgtattgcttaatgagcccaaggcctacaattactctcagataataagagaggtttggaggcacattaactctttcaaaccactaaccacctaatttgcaattagggaatatttcacagaagatataatagaggctgttaaatggttttagatatttcttcaaatttgcaccataaaactttatggaagagcaaaaagcgtggtttataggtaatgattatacaatgcaaattaatataaactgtgaaagactttcatttttagtacgtaaatagaatatgcattcttcataagacatgggatactcttagactctgtgatacttcaagttagcaaacattttactttatgatcaatttaagtataaaaattccaggttggttttactttcttcatcccaattacaattcaaagcatcatttgtatttgatagagataagtattaatatttgagctgcatagtgagttcttacggagactactcaatacactcttgagattaatttaggcatcagtagaatgcaggaaatactagtgtttttataagtaacatttaaaaaatactcaaaacttagtcaaagggtaagtttttctgtgtttttagtggttataccattacattttctaagaatagttaatgatataacacaaacaataagaaatttaattactctattgtttccttcagttctaactttccttattattctagtagtttgtggttatttttcagattatatagaatattttatattcgatttttatatagaatattcatttttatatataatatttttcagattatatagaagccagaaacaacacacacctgcattaacttttgccgtgaaacaatgccacatcaaatatgaacttgatttcaaccaaaacattttgtaccatatctctagtttgttttgtcccatacctctagtttttgtcaggtttgaactaccatatgcactataccttcaaaaaacctttaaaagtgctgcatttctaatatcatgtgagcagaacagaatcacttttatttattctaatttcttcaatatttattttcaaaatttatgaaagccttggaatttatttaagcagatttattaccacttcatatttactaagactttaaaatataatttgaatttaatgagatctcctccatctcaaagaaaaatattttttagctgctcaaatagtttttgagcaaaataaacacaatgttgtctagtgtccactgaaataaaaatatttggtaactaatagtgcctcgtactgtgctgtgtatatcaggaaacctattgtcactttatagggaagacaagcacatgtgaaaaaaaaaagttaataaaattcccacgcagtttaaaaaactacatgtcatagtttagatgtttgtcttctccaaacctcatgttgaaatgtgatccccagtgtcggaggttgggcctaataggaggtgcatgggtcatggggctggatccttcatgattagatcagtgttttccttggggaatatgaatgagttcttactttttttcttgaaagctggttgtttaaaaagcctggcaccccaacccctctcttgctttctctctttccttgtgatttctgcacataatggttctgtttcaccttctgctgagtggaaactcctgagcccctccacagatatagatgttggtgccatgctttttgtacagcctataaaactatggggcaagtaaatacttttttgatgaattacccagctttaagtatttctttatagcaacacaaaatggatgaagatactgtgtgatcctgcatgatttccatttggattttaaagtagcacttctaacccctatcctcagctttgtacagaaaaattttcaaaataaaaatgacacgaattagcatgattcatacaagacagcacagcacaaaagtgcagacctctttcattccaaaactgtatttacttcctaaaccacaactttctgttgctacctggattatttccttcagataagcagccctaaatctttacctattcattcattcagcattcttataataaggaagctaatcatattgtatatagctatataatattctttgctggacaaaggtgtaaaagtgcagtagaaaggacaggtacaaactctgtgttctgaggtttaggatcccaagtgatcataaaatgtatagtgtactggataagagtagaagttttaaagtgataaaatccaagtttgagctttttccttcatcctttaccagtttactgatcttaaaaatacatttctaagtctcatattcccactccaaaatgccaacaatatttctcttaaggttactgtcaagattaaaataggattaatgcaaataaagttcttatctatcatccttgaaacaagtaaactctaaataaatcatttttattgcaaacttaatctcactaagttttgttcactggaagtgcaattagaaaacattgattaggccgggcacggtggctcacgcctgtaatcccagcactttgggaggccgaggcaggcagatcacgaggtcaggagatcgagaccatcctggctaacacggtgaaaccccgtctctactaaaaatacaaaaaattagccgagcatggtggcaggcgcctgtagtacaagctactcaggaggctgaggcaggagaatggcgcgaacccgggaggcggagcttgcagtgagctgagatagcaccactgcactccagcctgggcgacagaaccagactccgtctccaaaaaaaaaaaaaaaaaaaaaaaagaaaagaaaagaaaagaaacggaaaaaagtaaaagtaaacattgattaatatgtcctacaactatgtaccttagaaaaaaaagataaatatccatttaaactaagaatcttattgaataataaaatgttaacatccaattagaaataaaactaagtcattgctggtataattttgctaacttccacactcaatctttaaatttggtgcatactgcaaattttttgtattattctcaactgtcgattaaagtgacactcattgttatttctagtgtgagtagtctgacaaccattcatttattttgagacagatttctgacgttaattcaaatatgtccaattctccattcaaacatatgtctttataaacttatttatttgttatgtgtggcatactgaaacatatattgtacagtaatttttcccagcaattaaaggttgcatttcttttctcagtatgcaactcctgctgaagtggaacatagtatataacaggtacaatgctagacattgaattatttgatttcaggagatttatattaatcctttagctagttgtatactcctatcagaaaattaataatccttttcagcagatggcaatgggaatcaaacaaaaattgctgtttcttattatcttttcaaggaataacgtattaattctagccactgcctggcatccctgtattatgtcctcttcaaaactaactttagttaatgcgttagatacattttgggtggtttaaaagaaagttagggccgggcacggttgctcgcgcctgtgatcccagcactttgggaggccgaggcaggcggatcacaaagtcaggagatccagaccatcctggctaacacggtgaaaccctgtctctactaaaaatacaaaaaattagccgggcgtggtggcggacgcctgtagtcccagctactcaggaggctgaggctggagaatggtgtgaaccctggaggcggagctctcagtaagctgagatcgcgccactgcactccagcgtggacgaaagagcgagactccgtctcaaacaaaaaaaaagaaagaaagaaagaaagaaaggtagaaagtgtgatttaaatgtttagttgattacagcaaagagaaaagaaacgaagaacaatggtatcaagccatggaatagtgtcctgtgactatgagttaattaattttggtctattatttggccagtatttttccaatatacttactctattaacagttcaatatttgcataaattaaatattttgaacgataataatcagctaatgattatatttttgttactgttctaaaattgtgatttttagttagctagcaagctcagtttctaaacatcccaaatatagcactgaggggaataaatagcatattcatcataaataaatacttgacttttttggaatattattttgtgctttgtattgcactgtgcactttacatggattattttatgtaatcattataatagcatgaaatgagtgttattattaccttattgttataattatttattttaataagagcagttttaggttccaggaaaaataaaatggaaagtgcaaagagggctcacgtgtctgttactcactaatgcatacagcctcacccagtatcaatatatcacacccggttgatacatttgtcacaattgatgaaccacccttaacatcattcttacacaaattcatagtataaattggggctcacttttgatattgtctaacctataggttttgataagtgtaaaaaatgcatatccaccattgtagtattctgcagaatacttttacttccctaaaaatgctctgtgctcctcttatttcatccctcccttcctcaacactactggcaaccactcatattttcactgcatgcttctatcttttccgtaataccatatggttgaaatcatatagtatatagtcttttaaaattggctgcttttagttagtaatagacatttatattttctttttttgacacttaataactctttttatttatttgtttgagatggagtttcactcttggttttttgttttgttttgtttttgtttttgtttttgttttgagatggagtttcacccagtctggagtgcaatggcgtgatctcggctcactgcaacctctgcctcccagattcaagcaattctcctgcctcagcctcccaagtagctgggattacaggcatgtgccaccaggcatggctaatttttcgtatttttagcaaagacagggcttcaccatatcaatcaggctgttcttgaacccctgacctcaggtgatccacccaccttggcctcccaaagtgctggtattgtaggcatgagccaccatgcctggccgacaacttattttttaaagtactgaataatattccatagtctagattaccatagtttatttatccattcagctgctaaaggttgcttccaagtttggacaattattaataaagctgctattacaagtttttgtgtggacaagttttcagctcatttgagtaaataccaaggcgcatgattgctgtatcatatggtaagtatatgtttagttttataagacctcaacaacctgtcttcaaattggctgtaccattttgcattcctaccagcaatgaatgggagtccctgttgctctacgtgctaatcaacatttagtgttggcagtgtttcggatttcggttatcctagtaagtgagtagggatatctcattgttgtttccatttgcatttccctgatgacatatgatgttaaacatctttttatatgcttacttgtcatctgtatatattatttgatgaagtgtctgttcaggtcttctgcccatttttcaatcaggttgtttgttttctgattgtttttttttttttttttttttttgagacggagtctcgctctgtcgcccaggctggagtgcagtggcgggatctcggctcactgcaagctccgcctcccgggttcacgccattctcctgcctcagcctcccaggtagctgggactacaggcgcccgccactacgcccggctaattttttgtatttttagtagagacggggtttcaccgttttagccgggatggtctcgatctcctgacctcgtgatccgcccgcctcggcctcccaatctgattgttgatagtaagagttctttgtatattttttatggcaatccttcatcagtggtatcttttgaactattttctttcagtctgcagtttgtcttttcattttcttttgtatattttttatggcaatccttcatcagtggtatcttttgaactattttctttcagtctgcagtttgtcttttcattttcttggtgttgtctttctcagagaagaagtttttaattttactgacatcagcttatgtatcttgtcactggtgtttcatctaaaaagtccccatcatacccaagttaatctatgttttctcctatgttatcttctaagagttttatagttttgcattttacatttagatctgtaatccattttgagttatgttttgtgatggatgtaatgtctgcatatagatacttttttatgcagatgtctagttgttccagcagcatttgttgaaatgattttctttacttcattgtattgcctttgctcctttattaaaaatgagttgactatatttattattattattacttaaaattgaaaattgtcttgaaaattacatgcagacacaaacacacattacctatgtgttctgtttctctatatctctaatctgtctgtttattaattcatctagtagatatttatttgtgtttttttaaggttgttaaatggttgtactctttagtaaatttcattatttcttaatctggcatgtaagatatcttttcatgtggtaataatatttcccacctactctgcaagtacctttctgaaccttttctactatttttattccatccaaattggatttctcactatcataaatccagctcatcctttgtttcttttagcatttttatattatttttcttacaaataattcctttctctatcccttctgctatcaatattctatttattttttctgaagttctttgtaacatactaattatatactacaacttgcttcttaatcttttgctattatcttcattttcaaacaacttttcattgatctcagtttacagattttactcaatgatgtaataatttattcctcatttgaaagataaaaatagtaagaatacaggatttgccaaaataatcagcgaattcagtgtcagttatggcatctgtaaactgaggaatctgcaaatttttggtcttcatttatttacctataaatataaaataataatatgttctcaaatattttaaaagtttcctatgatataccaattagataaattaatgtaaatatgatatatgatctgtaattcattgtatgactctcagaaaatatctgcttttgctcctggtctctatcttaaattaaaaaagcataactgaatgcattattttgaagtatgctagatgtatgtatctatgtatgcatctaaaaatttataaaaattatgttttcattaaaatcaagtacaatataatgtatgatgcatatgttttatagtgctatactagctaaatagttgtgaaatagttgtgaaatgcttaatgcttaaaaagttactcttttattggtttactattttaatttaaatgtacatgtaccaaaaatatactactggctcatgattgcatcatgtttaaaggttttaaatctttattttcagtagtagattttctaggtgtatataaattagttttgtactgaaaatcaagatcttttaggaaaatttacacaaattcaatatttttggggaaataaaaagattaaaatcttcaaagctagatttcataaaaatataatttattaatagaatatttctggtacgtatcaatagaacatctcatgaaaacaagcatgacataatgttgaaagtgagaataatcatatttgaactagaatcatattttgttataagaatttattcaaaaaaattaaacaaagatgaaaacacttttctttaaatttaattaagataaattcaggaattcataaagataactctaatatgtctatttacatgtgttgagtatatatttgtaaccataatttaataacatttgatttttgtgaacttatggaatatatgtaattgccttggaatcatggttcatatacctcactccactcacaaatgtgtgtgtattatatctactttgatataagacagattattttattattatataaaaatggtttttaataacaaagataattctaaatatctcttttttcctaatcatgttcttctgaaatcatacaatgcaatagatgttgtgcaactgatttattttagctatctagtccttttattttcatataaatcgagaatataagcaaaagtccatgtgcatacaaagaagagctgcatcttcttggcatttctatggttagtttcagccttttatattaaacagtggttgaaatcacattcttgatgggaagtatcttggtaggatgttaaaaggctatattgtgctcttattttattttttaaaaattagtagtttaaacattgaacagtctttttccctacttaacattattccaggcataaagtttcttcatagcatagcttacagtaagccaaaacagtaaccatagcaaatgttaaagaattgggcttaaatacttttaagtagctactttttttcaatttaaggtatgaggttcatttcaaatcatgtgaaacatataaacgatattattgcatagatacctgatttagttttcttgtctgaaaagaaaaaactgcaacttcattcaataccactgaaaggacaaattccattcttatcattttaattaagctacaacacttaaggaggccgggcttattttatgtccagaatagttgttcatttctgtacctctataataatttgagataggttaaagcaaataaaggaataggattcaaggcttggctaagtcattttatgagaagttatgataaaatctcttggtcaccatggttcattgaaaacccaggcatagagaatttcatcttttatataccattcataaattggattttttttaaggtttgggggtctgatatccttttatgtcaaatgtatttgtggtaattgtattagcaagaaatttggagaagatattactgtcattagtaaagatatagccagtggccaggtgcagtggctcactcctgtaatcccagcactttgggaggcaaagacaggaggatacgttgagctcaggagtttgataccagcctgggcaatatggtgaaaccctatttctacaaaaattagaaaaattagcctggcaagatggtatgcacctgtagtcccagtactcaggaggctgaggtaggaggattgcttgagtctggaaggctgcagtgagccatgtttgcaccactacacttagcctggacaacagagtgagatcctgtcttaaaagaataagtaaagatataaccacagtgttgacaacagtaaatgtcagtaaatataccactgcaaaaaacaatttaaatagtattgcatggcatatgcataaactttctaagcatatgccatgtaataatatttaggtgaacacgtaaacaaatttcgtatctgtggcacagtgttttaagtgcattcttcaattaactcttcatgagattgtttcttgctgttacttcctttactgagaccttgaaccccttaaagtcatccacgaggtttgtaatcaacatatttcagattcctcttattgttgctaatttgacctcccatgaatctaatggcatcttagaagggtaatagcatatagaagagtaaatcctttccagaaagttttcaatttactttgcccagaaccatcagaaatatcactatctataacattacaaaatgtttctcttaaaagataatacttgaaattcaaaatgactccttgatccatgagctgttgaagggatgttctgttagcaggcatgaaaacattaattttcatatatatctccattagatttcttggaggaaaaggtgcattttcaatgaacaataattctattttctgagcagtaggtctcaacagtgggcttaaaatattcagtaaacaatactgtacacaaacatgctgtaatctaggctttgtttttccatttctagagtacaggcaaagtagacttaccgtaattattaaaaaccttaggatttttgaactggtaaatgggtattggcttcaactcaccagctgcattatcccctaacaagagattcagtctgtctttttaagctttaaaggcagtattgtcttcttctctcttgctgtgaaagtcctagatggcactttctttcaatataagactgtttcatctacatgcaaactgttgtttagtgcagccacgttcatcaatgatgttaactagatcttctgaataacccactgtagcttctacatcagcacttgctgcttcactttgcacttttatgatatagaggcagcttctctctttaaacctcataagtcaacctctgctaacttccaactttacttttgcaactttctcacctccttcatccttcacataactaaagagagttagggtcttgttctgaattaggcttttatttaagtgagtgttgtggccagtttgctcttcaatccaggccactaaagctttctccatatcagcaataacgttatttcactttcttattatttgtgtgttcactggaatagcacttttaattttcttcaggaacttttcctttgcattcacaaattggttgactgtttggtgcaatgggcctagatttcagcctatttcagcttccaacatgtcctcatgactaagcttaatcatttctagcctttgatttaaagtgagagaaatgtgacttccattcactgaactcttggaagccattgcaggcttattaattgtcttgatttcaatattgttgcatctcagagaatagggggagagatgaaggaatgaccagttgatggagcagttagaagacatacaatgtttactgatcgtttgccatcttatatggacctggttaatggtgccccaaaaccattacagtagtaacatcgatgatcagtcatcacagatcaatacaacaaatataataatgatgaaaatgattgaaatattgcaaggattaccaaaatataacacagagacatgaagtgagcacatgctgtttgaaaaatggtgccaatagacttgctcaacacaatgttcccacaaatcttcgttttataaaaacacagtacctatgaagtgcaataaagggaagcacaataaaatgaggtaagcctgtacctgacagaaccctgcatcaaccacagggttgacatctctaagtttcaagcccagttgcctggggtcaacctatttttgcctcttaccaattgtgtgaccttcagccatccatgagcatattagcatctgcaaaatgagagtaggtctgatgataatacagttgcgaagattttctgtgatgattacacaaatattttagcagaatgcctgcaccatatcacatgctcagttactattagtcattttattcagtgttattatgtaaactttcaggacgttgttttatcaccatccagcagatcctaagatgaaaaagtgggaatagaatagaaaggcaacctctaaatcaattgctagaaaaaaaatcgtcaagttattttccatttaatatatcactgtattcaagaataggagttattataagagtacttttactatgaacatgcatagagcattttcatcctcatttaggttatgatttatccaacaaaccaatatatgtcaaaatgttcctctgactgaacctagtttttgttaatttttatttccagagttcatttcagagttaattcataaccttccagactaatgctactagaaaaaagggctccttcaaaaaagaaaagaaaaaaaatagaagcaaataagaaaaaaaacaaacaaaatcagttaccacagttaactataatcaacatgttagcaaattgtcttctggaatttgtttatgtatgaatacttttacacagttgagagcatccattttatactactctttatttttaacattagctcataaacattttttctatcattaaaacattttcaaaaaaggctgtttctttgaaatttaaggtttgcatctcataaaatacagggacctaggggcatgcacaaagtgtgatagcatgccaaatttaagcttatttccatgcttgtcagaatttttttttaattagaaacatttagaaaaatagcatcacaaagtgaggggaattctctttttttttctggattcaacaacagcttcaaaataccatcttatatttctattccctcttatatttaacagtttgccctttctccataattaagaacactggagagtttgatagttatgcaaataaaatcctgtgattcactcttggtatattcattgcatttgaatgtctgaagccataaagtgtagtgctttagggtaacagtaatagaggagtcttctttgcattgaagaactgtcatcaaaagtttttatgtaactgatttgttgcaactccagaaaaaaaaaaatcttttctccaacctctcatttttggaaaactaagagatggaaaaatgagaaggaaatgtcagaattattgaagtgctaagagcttgatggcagtaaatggcactgatattggctgacaattctgacattaaaatggaaggtcaagatgtgatttgggtctcttacatattacaaaactttgatttacatctaggcctgactccaagttttcatcttccaaggattcagacatatcaccaagcatgattcactgactgatactttattgcctcctttcaggcagtgtatcatacatttacaaaattcattaatttttcacagttaaacaatgaatacaacgtgattctgcttttcctacagcagaccacaggcaatgttttagagaaagatgactgcttcaaatcctacatagacttaaactctcaggtataacatcatttttctatttaatcctaatgcacagtggttatgctccatcctctaatatctgttcatcaattcagaaaacataaggacacaccaaaaatgtaccaaaatgccatgagtgtaattacaaactaaatattttcaaaaaaatgaatgaagttatttctctgaaatctctcttataggaagtatgtatttagttacttaatttttaaaataatttggggctccaacgagtgacatcacatgacctgaaataagataataagatttataaatacatgactaataattatcttcatctgttaaaactgtgattcaatatgagttccacaaactgaacattgtattgggttatagatatagattaaatacatatcttagttacgcaaaaaggaaaagttttgactttagctcttaaacatataataattatagcagtagtaataacttatatttttttattaagacattaataacttgagagttaaatgtatactatataaaacatgtttcatcttgacatgtatagatattctatgattctcatcaaagaatgtcactctgggttttaaatctgttcttatcacccagaagatcttatctggtcagtatttgattagagaatctagctacctaagacaggttttcttcatttgatagataatctggagcttcaagactattgattgaagctgcattcaagtaaaaaaaaaaagttaagaaaaaaagtggaagttaaccttgactacacttcaaccttcaacttctgctgccttgagtcaaacagctaaatatgtccctgtcttatcaccacagattttttcatattgactgaaaaacaaacttcaaatgcattttagcctgattattttttgaaaatatcatttaagagtaaaagaatccttgatcttctctctttctggtatgtttattgaattaatataaactcaattcatttgaaagggcactcagtatactttaagtctattgttattaaatacaaaatagaataagaccaatgtctcaaaccattcaaataaatcaacaatagcaaaatatagactaatatgaagttttcttaatagattttttttttttttttgagacggagtctcactctgttgcccaggctggagtgcagtggtgcgatctccgctcaccgcaagctccgcctcccgggttcacgccattttcctgcctcagcctccggagtagctgggactacaggcgcccgccaccacgcctggctaatttttttgtatttttagtagagacggggtttcaccgtgttagccaggatggtttggatctcctgacctcgtgatccacccgtctcagccttccaaagtgctgggattacaggcgtgagccactgcgcccggccatgatttttagatcattcactgctttacccaactacttcatggatccttctaatgaaacacagctgggatttagaagctaccaaagtcaggcataatgagcttaaatgcatctgtagacatttgagcactgctcactatgcattttagtataatcataagccaaataaaagcatctgtaatctctgtccccaacgaacaaaatagtaaaaatattacatagatattagacaaaaattcagacgttataaaggctaatttaaaatcagaaaactgcatattctcacttgtaagtggaaactaaatgacgagaacacacggatacatggggaacaacacacactggggcctttcgcagggtggagggtagggggagggaggggatcaggaaaaataattaatgggtactaggcttaatacctggatagtgaataatctgtacgacacaaccccattacacaagtttgcctatgtaataaacctgcacttttaccctgaacttaaaataaaagttaaaataaaatggcctggtgtggtggctcacgcctgtaatcccagcactttgggatgccgaggtgggcggatcatgaggtcagaagatggagactatcctggctaacacggtgaaacctcgtctctactaaaaacacaaaaaattagccaggccttgtggcacgtgcctgtagtcccagctacttggaaggctgaggcaggagaatcgtttgaacccgggaggcaggggttgcagtgagctgagatcgtgtcacagcactccagcctggtgacagagcgagactccatctcaaaaataaataaataaataaataaataaataaataaacaaactaatatcaatttacataaaattaaatgcacacattattagtgtgcagtttgatgaaatttaataaggatatactttagtataatggacaatccaataaagatttgaatgttttcaggactccaaaaacttctgtccaggccaattctcttcagtcttgcagccaagcaaactgtaatgtgctttcactcactaaagattcattttcatttctaaaattcaatacaaatggaagcattcagtatgtactctttggtatctgtttttttgtcacccagcctatgcttccaagatttatctatgttacagcatgcctttttatctgatgagcatcccatcgtgtagatatccaccaaatatgtttattcattcaactgttgatggacgtttgtgttattttcaacttgaggttattataaatgaaactgctgtggacattcatgtacatgtattgatatagacatacgtttttatttgaggggagggtaaaaacctaggagtaaaattgctgagtcagatgaatgtgtccatttaaattcaatagaaacagcccagctgttttcctccatggcttttctattttactttcccagtaatggtgtattgaagttccagttgtttaacatcttcaagaattgtcagtcttttaaattttagctattctaatggatgttatggaatctcactgtggtttcaatttgaattttactgatgaccaatgatgtgagaaacttttcacgtacacatatgaacagttgtatttcttttgaaagtgtctgttcaaagtttttaccaattttttattggattatgcattttattgatttcttatatattctagacacaaatactttttccccccaccccgagacggcgtctgtcttgctctgtggcccaggctggagtgcagtggtgcaatctctgctcactgcaacctctgcttctcgggttcaagcaattcgcccgcctcaacctccaagtagctaggactctgtgcgcgccaccaagccctggctaatttttgtatttttagtaaagatggggtttcaccgtgttggccaggctggtctggaactccagacctcagttaatccaccggtctcgtcctcccaaagtgctgggattacaggcctgagccaccgctcccagcaaaaaatgctttgttaggtatatacactgcaaacattttcttgcagtgtgtagtttgcctatgtattttcttaatgttgcctttcagagtaattgtttttaatacactgaaattcaacttatcacattttttcctttatggttcataattttgtcttttatttaaaagattttgcctaccccaagaaagcaaatattttctcctaagttgtcttctttaattcatagtattaaaatttacattgaatactatgatgcaactagagttaatacttacgtatagtgtcagataattatccaggttaattatttttatatggatgtccacttgtttcaggaccaattattgcaaagtcttttattttcctcatggaatttacttggcatctttactggaaatcaacaggtatgacaaatttctggaccctctcttctttgtactaatctgttgtttatacatcattattatattgtttcagttgccatatcttatggtaagtactgcaatcaggcagtataagtacttaaaatttggcttttttcacaattagtttggatatggtaagttgtttgcacatctgtatatattttgcaataagctttccaatttctataaacaaaaaaaaaacccagctgggatattgttagggattatattgcaactctaaattcatttaaagagatcatatttctgaagaattatggctttttacatgaacacagcttaactttctatatttagatatatttaaatttgtttcagcagatttttgtagctcatgagaattgtatagatattgaggatattgtgtgaatatattcttaaccatatattttatgtttggactctattctaattaaggtttaattttttaattgttcattgcttttatataagaagagcactactttttatggtctttgtatcctgggaccttgctaaaagaatgtattgtgtcaagtagctttcttgtagattccttaaacttttataaccaaaattatgctacctataaatttagacgtctatttctttcttctaatctgtaaatctacatgcctatagttcatttatttattaccttgtgcaggatcttcagtacagttttgaacagagatgttagtgtgggcattctcacctcattttcaatcttaagacaaaagtgttcaatatttcaacagcaagtgtgcaaattactctaggttttcagtagacatcctttatccaattgtgaaagttttctgctgttcctagtttggtaaggattttgttgtgctttgatttattatttatttttaatacagaatgaatgttgaattttgccaaatgtgttttattcatctattgatacaatcaaatattttttctttttcttttgacatggtgaattatattggttgatttttcaaatgttaaagaaacctgctattcctgagatgactccaatttagtcatgatatgtaatacttttaaaatattattgatagtatttgctaatatgtgaaagggagagagtaaatgaggagttattgctaatggttacagagtttctatagggtaatggaaaaagttttggaaacagtgatgatagttggtaaatgtaatgaatgccactgatttgaacactaaatgtttaaaataccaaattttatcttacatatgttttaccacaatattaaaaaaaaagatacatgtgaaagtttttcaaacttgtgatagctttagcaatgcaattacctgaaaagttcagtaaactgccaatatacttgatgtcttaaagctctctgggttagtatcaacatattcatgccctttggatatgtactatgccttggtatttctgattcttagccagattcttaacaacacatatctcagccatgtggccccattttgttctctgtttttaacaaacggtaacgaatgagacaaggttaatttctcacttgcttcagagtgcacaagtgtaatcattactaatttcaggcatagttttcataggagagattaccccaaatttcaaaggaattagactcttacagttattggttcccaccaactgctgattctaaatgtcatgaagctttgctctctttaatattacctttgtgcaagaaacttgagttgtgtaatctcacaaaaaaaagacaattatataaatttttgcatatggttttacagataaaaaagtaagagtgtctttttgcaggttgtcacctcttgcccatgtgatttccattgagcagtttagactaaatttgatatgcttggtggtgatgctgcttattataatttttgtgattggttttagtaatttgtggaatcttacagaaagtcacaagaagtaacgacaaaatctaatatcctgacattttaccatttacatttcaagaatggaacatagaatatataaagtataataaaatgtacatatttatcaaatgctttactaccatatgaacgtaaccatcaacttccaatttaatcatttatcatttgcaataccttacatgcagatattgttttctgtactagtcacagcacatttggatataaggcacaaaaacccaaattaaactatgttaagttgtaatgagatggaatgcattgacctacataacaactactcaggagaagatagacttctagcatagctcaatttaggaattcaaacatgaaataaagaatgcaattctctctcttcaagattggaaggctcttgttcacaaattaagcaaaaatgcctctggcaacataattcttatagtttatgatacttgagcctcaggagtttaagaccagcctgggcgacataacaagaccttgtctcaaaaaaataataataattctcccgaaaagttgtaactgaaaaggccggaaaaatcatgtggttaatgtcaacatttattttggccagaggctgagacagtataatgagcagttttattgtttctattcaagccctgtaccctaaagaagatgagttgaaatggttaacctgcctcagttaaattgaacatgaattcctcagaaaagagagcttggcaaccagaaagtagacatattctgttaatcccaaagcaaaggtacatatctgcagttatatttaaaactggaatataaagtattatgtcaatgataattaaatattggagaaaataatagggatgccttgaaaattactttcacaaaatagataatcaagggatacaatttgtctacctcttctcatttctctcaacagaagaaagttaaatttaggagattatattttacagaaactataaaatatggaagctaataaaatcaggtttggggaaaagatttttagattcttttattttattttattttattattattatacttaaagttttaggttacatgtgcacaatgtgcgggtttgttacatatatatacatgtgccatgttggtgtgctgcacccattaactcctcatttagcgttagatatatctcctaatgctttccctcccccctcaccccaccccacaacagtccccgaagtgtgatgttccccttcctgtgtccatgtgttctcattgttcaattcccacctatgagtgagaacatgcagtgtttggttttttgtcctggcaatagtttgctcagaatgatggtctccagtttcatccatgtccctacaaaggacatgaactcttcattttttatggctgcatagtattccatggtgtatatgtgccacattttcttaatccagtctatcgttgttggacatttgggttggttccgagtctttgctattgtgaatagtgccacaataaacatacgtgtgcatgtgtctttatagcagcatgatttataatcttttgggtatatacccagtaataggatggctgggtcaaatggtatttctagttctagatccctgaggaatcgccacactgacttccacaatggttgaactagtttacagtcccaccaacagtgtaaaagtgttcctgtttctccacatcctctccagtgcctgttgtttcctgactttttaatgattgccattctaactggtgtgagatggtatctcattgtggttttgatttgcatttctctgatggccaatgatgatgagcattttttcatgtgttttttggctgcataaatgtcttcttttgagaagtgtctgttatatccttcgcccactttttgatggggttgtttgtttttttcttgtaaatttgtttgagttcattatagattctggatattagccctttgtcagatgagtaggtgtgaaaattttctcccattttgtaggttgcctgttcactctgatggtagtttcttttgctgtgcagaagctctttagtttaattaaatcctatttgtcaattttggcttttgttgccattgcttttggtgttttagacatgatttttagattctttgttgataactgatgctagacatttgtcacccgtgtgagagcattgtgtaagtcatgacatagcacatacgtgaataggtcatgcattgtccagtgtgataacagaggaatttgtttttaacattaaattacattcacgtatgtacaacatatgtagatgattaaattttaaactatcaaaatttacagttaccctagtataacaataactcaatctcaaggaagaaaaatattgacaagcagaaaaatgtttaagagatgaaataattgatccattaggaatagagtaataaatatgcctttctaagttcaaaggggagaaatgactaataccacaaaagcaagctaatgcaaaagtatgcttaagagaaaatacttcaaccaaaacaatatgtaagaaagttattatgttaaaactattaaagtgtggggaatacttcatcaattagtctaaatattaatatagaaatttctaaaggtacgaaagtacgttatatgaagtaatgaaagtgcaaaaacctagtacatataaaactgtatatatgagaaagtaaaaatgttcattttgtgccatggaaaagaatgccaacaaatgtactaataaaatattaagataaatcattttgtaattataatatatgcattttatatttataaagaaaaataggtaatttataacagtcattagaatttatttggcttgtacagaacaagccaaataaaaattaaaaattattaaaatgtaacaattaaaacagtgtaatttcaatggaacaaaatagaaagaataacaataaccccaatcacttatgagactgttatgcatagtaaagctgacttctcaaaacaatgtcagaaatgtattatatttaataaatgtggttgtaattattaagtagctgatgaaaaaatgcacttggatctttatgtatcatctaacattaaagttattataggcatatcaaatatttaaaagtaagaataaagctacaatgttcaaagaaaatacagtggaagcctttgtatgatatgtttgttattgattcataaatatttgtacattatttatggggtacatgtaatatttcattacatgcatagaatgtgtaagataagtcaaggtatttaggatatccatcatctctagtatttatcatttctatctgttgggaacatttcaaatcctctcttctagctattttcaaatatacaatgcattgttgttgttgttgactatagtcactctactgttaaacattagaacttattccttctatctaactgtgtgtttctactcattagccaacctctcttcatccctcccaactccaatccacataccctttccagtctctggcatctatctgacatctatcattctactctctaattccatgagatcatttttttttagttctcatatataactgagaaatcagtgtatcaaaagtatgcactggaagaacttctacaacgacacagaggtcacatattttaatatctaaaaataaaataatatcaaaggcaagtgaccaatgagtttaagaaaataaaacacatctcaggattagtttccttaatttttaaaaagttcctgaaaatcaatatttctaaagtttagtaaaaagagggcagtttcaattgagaaaaagaaatgcaaattactcttgattacatattttaaatgcttaattgcactgctggtaagagaaaagcaactcaaaactacttggagataccagcctttacaccaccttgataaacaccaaaaaggtttgataacaatattttaatgagtggataagaaaaaaaattccctgttgagggaaatttcataatatctatacaaattaacatatataatgtttgattcagcagtgacactttagtaatttatctaatgggcgtgcgtgtttggccatatgtgagtaatatgtacatgagttttttaatttaaaaaaattatttttaatagcaacatccaagagaaagaaagcaggacaggaacagaaagagagaaaagaccagatgtttacttaattaatatgctacaatacagctagtaaaaagaatgagacaactttatagacactggtatagaagaatggtatattattgaattaaaacaaactataaagaagataccgtcattcatgcgtgatctaaaagtggatgtgtacatatatgtgtgtacatatatacatgtctcagaaagaataagttatatataattattaattgtatattataattatcatataattatatgtacacatatacacaaatgggtaatacatttctgagggactagcatgggatggcgatatattatctttccactctttgtattaaattattgcatttacatattcaaaaatgaatgcaaacttatattagtttggtgcaaaactaatggcagaccccagttacttttgtaccaccctaatagaacataatattgcttctgttttggggatgtctttcatattggaagacgagactcaaatgctatttagaaatcaagcaaaaaaacccgtggtcaaagaaattgagagaaataacaaggaacgctagctgcagattgtgtaaagaatttcagggactgtagaaggtgcagggtatgatataggagccatttatatggggtagctttggggtttaggtgtggttgcatttatttaaatccatgctgaatggtatttggtgtagacatttgaattccatttaacacattccattgtgtttgttaggttttttcactattttatttttccttggaagatattaatctcggtgaatcagaaaaaggactgcatttcactacatttagagacatacagtttactgaagtactatacaagtgagacaaagtttgctttggcattttattaatagagaataacagtagagaggtcagaaattcaattagggtgggggtaggttacagaaaatagatattgatagaaataatgtagatataaataaagatgtaaatgcatagatgtagataaagatttagattgagatacagatatagatacaggcagacatatttagacaattattaccagtagataggaaagtaagtagagtgggaagttacagtttgaggctttaaagaagaaaccaaaatatttgaaaagtaaaaatagatgaaattcaggacacagtttaaatttagagaaaacatttaagtgcttaagcttcggagaaaagatggaaaggagagaggatgaaattgattaaagaaatatttaaagttctagaaaggaatctctagaagctgtcttcatggcaattaatgactaaacaattatatgtggtttttaaaatcagccttgggaaattcctttagatacaaggcagcttttctgtaaacattaaaatcttttgagtgtaaactcccaaacaagtttttccatgtttgcctaaaagtggatataaaggattggccttcctagaatgagggtagattttcctgaaatcatggtaataaaggcagctttatagagtatagtataaagtatagagtatatactttatatttctataggcaggataaagctacctgggtgctgaatttacccttgaaactacccgtgagaagtgaaactttttaagcctcactattttttcagtaacacgagatgtttgctagattatctctatgtccacctcctaaaaactgtatcaaatgataagatgaactttacaaatttcttccagcaccagggtctgtaactttatgatatttctgtgcactagcatgggacaaaataaattattgtttatgtctacttcctaccatctggggatcttatttctgaagcagtcataaaagaatgtttgcttataaattattcccagggatttttttgcactcttagtttcggaactgcctctgcataatatgaaatgcattgtttcactgccaaagctgaggttgacagcctagggcttgcaggagaatatttttgcagataataactccttcttgcatgtaatagaattcatgattccatacatcttctcccaattttacatacagccatatacacatagaatgtagctatttaagagttaatgacaaataaatcaataatcattctccgcactgcagaataagatgatcagtctagtttcatgagtgacttcagatctgggaggcagaagacaattgaaaaatagggtggtctgagatacagatttcattcggaattcgagtagctaaatataaccacatataacacacacgtgcaaatcacacacaaaaatacactgcttcagggtgacaaaaataaattagtattgaatatgaaatgattaggctattattagaatataaaatattttaatgaaatttacatataagctcttcggctgtaaaaatgagtgcattgtgtaaaatgatttttaagaccttacttttttagaaatatctacatatcatctatagagtagtaatagggtttttgctttttctacacatgaactaaagaacatgaacaaggataatttactcttttgactactatgaatcacctttaaataaaatattaaattaattaaatattggtcacttttttgttttattgctaaattttaaagggtttattttgttttgcctacctttgcacttttttttaaatcagaggctcattttctgatattgttcttaatacagtaaaatcactggtctgtcaatacttctctttgtttattcttttttctcttcatataactttcatgactttctccagaaagctatgttttcaataaataccacttgacttgtatgttattgttaaatgtatgtttggttttggaatgctcattttgtaataaattttgttgatgtttaatatgcattgaaaggcacaaattataagagtttacctaagtttttctcatgttaacataggtgattaatctacacaagataaagacatggaatattactaggcctgcacagatgccccatctccctttccagttacttccttcatcaagagcaatgcttacactgaaaaactgaagtctcttgtttcagagttttatgtaaatagaatcaaacactatgcactctttttgtttctgagttcttatagtccatgttattttctatcagatttatctatgttgttttgtgaaggtcatcttaatctgctctcataattctataacagacttcctcaaacattttactctggatggatttttgatcaagtttcaggtgtcagagaaactctaagtaaaatttataatatctacctttcaaagttaacatattcagtggtttatctactacagttgataggatttgactgtgcccccatccaaatcttaacttgaattgcatctccaagaattcccaagtgttgtgggagggacccagtggggaaggtaattgaatcatgggggctggtctttcccatgctattctggtgatattgaaaaagtctcatgagatctgatgggtttatcaggggtttccacttttgcttcttcctcattttctcttgctgccacagtgtaagaagctcctttcacctttgacctcccgccatgattctgagccctcccgagccatgcagaactgtaagtccaattaaacctctttttcttcccagtctcgggtatgtctttatcagcagtgtgaaaatggactaatacaacaatctaacaataagttgtcaatgatcttttgagtagcaaaagatatttctgtagatatgcttatttttagcttcttattcacctctttatgtggttttcccttccaacagtggatattaattctaatcagataaatattgtaggtacagaacatttttattttttaaattcctacttgattttttaactttactgaaaaaatcctaaaatcctaatcacaaatttcttctatactgtgtgctaatgattaatgagctgcgataggtgaaatgtcatgtgaggtttttctttttgatttaaaataaaaaactgtcttttaaccacaatttattggcaaaagtaaacaaaataaaacatcagcaacaaaagccaggttaagcttaactaatctttcttgaaagtaatttctttttcacaaatgtttaaaacatcaggcaagtattttcagacaaataactgttgtaaccaaatgatatttaattttctaaaggtgagcttggtagaatcaatttagtggatataaaattgcttttaagtcagattatttataacacgaaaatttattgacatgttgaaaataaatgtagtaataatataattatttaaataaaatatgaataaaatatagctttaaaacaactttataaaaaactttgataagacaacatttctcactgagtggcgtgatcaagtctaaatacagggctagaagttacaaatttattttacatatgtactagtttattgatctttttaggtttaacaaataactttggttaaccttgagaataggaacacagtgattttatatgaactaaaatgagattatttaagtctttgaactttttttttaaaaaatagcagtgtggtcacacattgatgaggatgaaaactacataaaaaattttattaattttctatgaatagcagtacagtcttcttttacagaacccagaacctgcttagggaaaatcagctaatcttaacttgatcatacgatcagcctgcattttgtaaagttatttttctttgctttgtgtcaagttctcagattgagcagaatttcagaaaaaaaaagggccctcacttgttcaagtgtgagtgttcaaagaggggaaacgcagctcaattgtttgctacatttctctcagatgggttttaataaaatgtgagatgttctgatattcttcacagctttcaaaccaaagctgtagtgaaaacttttcagtgttttattttacaacattttcagtgttcttaaatccaaggattttgtcacttgaagtcaaaacattttctcaatttcattgcagagatgtgttcatctaattttaaaatgtttaagaagagtcattctgcagataatcttcatttctgtagcactcaataagtaaaatctggccaatgatttttttgaaatattcttgcaattgacctttcagatcaaacattttattaaaaactcctcatctgctagactgccttattactatacatagcaggagatttacttgtgctttatctagattttcacaagtttataaaatattctggattaaacaagtctttgttacatgaaagtagtcgtttttgaagttacaactaataaatgcataagtagcttctagacatttttcacttcatttttttaaaatcacatttgaatgtgattttaaacaacatttggaaaagaacaatttggttcttttccaaattgttgttgctattgccatatttatagcaatataaataaaaatttaaataagctttacatttatataaatgttatatttaataaatttatatttacttatgtaaatacaaatgtatatttctatttggttacaaatgatacacaatggaacgggatgactcatattaccagtccacatgaaacctattgataatagctcttgttatagtaaccaacttgttggagatccttgtcgaattaagacaataaatgactcagaaaattataatgcatcatcagaattattcatactcctatacgtggaatcttattattttgacaccacttcttaaaaatacccatagtacattgacagatatactgtaaataataaagtctaataagataagaaatagaagtaaaaactaaatgaaaaaatgcaaaaacaaaattatcacaatgcaagatacttctaacttacacaatccgtgtttttcttctttctttctttcataacctgttttctaatgtttatcacagcagcagagcaagttgcacaacagagtgcaaacatttgcataaaaatgtttcttaaaatgaacattgtctctccaattttctattataagagtagattttaggctgggtgcggtggctcacacctgtaatcccagcactttgtgaggccgaggcgggcggatcacgaggtcaggaaattgagaccatcctggctaacacggtgaaaccccgtctctactaaaaatacaaaaaattagccaggcgcggtggtgggcgcttgtagtcccagctactcaggaggctgaggcaggagaatggcttgaacctgggaagcagagcttgcagtgagccgagatagcaccactgcagtccggcctgggcaagagagcgagactccgtctcaaaaaaaaaaaaaaaaagagtagactttgttcaatcccttaagcaggtcagcgatgtacaagaggagtttgggagcaataattggggagggagatgctgatgccatcagtcaactatttccactctgagcaataccatacacatcagtgatcagtggtctcccttataatggaagaaaggctatggctacataatttaactctccaatgatatatgaccatcttaaaaggcagtaagtacttgcaagtacttgctctctcagcacaatgtataaagcttcctttatcaccacatctacaccaacacctgcattcctcagctttctaaacctgccgttgaagtgctttgctggagtttcctgtgtattccagatgccaaatacttagaagttatggacattgtaaatacctccacagattctgtcaactatctgtgaagtctgtcaagatgtcatccattaaaaagaaagccttatctttgatgaaataaaattcatcagtattttagcttatggattgttattgtgaaattttgattaccaatttttggcaacattgttcatcaacatgtattgatagcattggttttataagttaacctataacctttatctctttatctacctgcaatcactttgtaagtgcattctttggtagaaatagcatattatttccttccatatagttacctggcatcctaatcttaacattaaacaattcaggttgcaacctgacacattgagtttctgaatacacttggatttgtctctgaatctcaattttttttttgtatggctgtttgtctgattttcaaaaatgccactctgcatgagaactgtggttctgtaggattatggttctgtaggatgttgtgtatctcttagggtaatttcttctatggtactcctatattactcttctttttgaagataacctagctatttctgggactttattccaccgtataaattttccatatctctatgttttataatttttatcataaaatataatatggtaaatgtcaaatttaatgagatttaaagtgagaaaataacatatagtgaacaaccacgtaaactgcatcacagaagggtcattttaaatattaccactacatacatttataaccccatcaaacaatgatataatttgcttttaaaagcaaagataattttaaaactcaagataaaaatagtttattccattcacaaaggtgtttgctcttttcctcttttttctttctttttttctctgttcccttttgttatttcctttatcatactaaagtattttctttagtaatactatcagagcagttctggtggcaacaaatttacttcgctttccttcacctgagattactattatttcaattttatttttaccggacacagaattctgtattgagagttctttaattttagcacttcttttgtccctgtcatctactattcaacccagtgtgtattttttaaaagaaaaattggttcttctaatatgttttctttatttgctaaggctttataattttaaagttatttaagagtgtccatgattgattattgcagcattgttgcaaatagtgatttaaaaatattttcagataattgtaacaattatgtcatttaggcatttgccatcaattgattattttctcattcaagttgaaattttcctgattcctggtatgtcaaaaaattttggattatatcctaaacattttgagtattataagactgtttcctatttaatggatgatcttccatcattgaaacacacttttatgtagagagcacacattggcccagttttgtgggctgtggcttaaatactcatttaattttgaaaatctttgttgggctattctaaccgattgggtttgtgcactaccaaaagatcattctgaaactttggaggtattttacaccgaagttatattctcaaggcatttaccatttgattctgattggtttcacaaataggcaacttgagatgggctgaggaatttatacacaattttaaatgattgttttatctaactcttttccctttgtgattgtacctttgcactctagttggaataagaatggtgtcacttctgcttgagttttcatactgtacattatagacagtggatagggctccactctgctctgtcagcggcagccattctggcttgaagaaagaggataaccacatctttgcttgtttttacctaatacaaggaaagtccatccacagggcacaatttataagtttctttgttagcagctcccagtgagaatggataagaacactattttttgctactgtttgctactaagtgttaactgaggctagtctacagggctctgtctcactgtccccttagcatcagtagctcctggagaggtggaaagacaccacctttttgttatgtacttctggtagcaaatagggttagtcattggaaaactggaccgtaatagcctgccaacaaaagacagtggtaaagaaggccactgcctatatgctgattgtaggcaatcacccgtaccctgcccccacaatctcattggtgacaaatctcagtgaagaggacaaggaattgttaaaaggagaaggtaattgttgcctgtttgcagcaactaccaaagtaaggagggagggatagtcctctgttagtggccatagcaggtggaatataatcaaaagtgtccaggaagcaagattgcaggataaaagatcagtatacaaaaatcaatcgcatctctatatataatacaataaatccaaaaataaaaataagaatacagttacattcacaacagcatcaaaaaagaataaaataggataatttaacaaaagaatttcaagttgtgtagactaaaagtaacaacattttgctgaagaaaattaaagaatatttaaatatttaagagatatctcatgtacatgaattaacaaattctttccaaataagtctttccaaattaatctagagcatcaacacaattcctctcaaaatcccaacaggctattttgtggagtttgatatcctatttctaaaatttatgggaaaatgcacaatactataataaaaagaataatttggaaaaaatacaaacagctttggagaatagtcacttctaaatttaaataattattacaaaaactatagctttgagagtatggtgttaactaaggaaaaacataaagatatgtaaaaataaataagaatattgacataaattcttacatttcttgtcaattcattatcatgaaggcactaaagcaattaattgtcaaagtatggtctgcgatttgtgcagtaaatgttgctgtaacaattgcctaaccacataaagtgaactgagacccttaataccttatacagagaaattaactcaaaacctaacataattaaatgcaaaagttaaaaaaaaaatttagaaaagaaaatagaagaaaattattgagaccttgtattaggcaaagaccttttgtagatataataccaaatcacagttcattaaaaataggtaaatacacacctcaaccaaattcaaaacatttttacttcaaaagacaccaaatattataatacaggcaacaaacagtgaaaaaaatatttacacaacaaatatttgataaagggcttgtgtataaaatttataagaacacttacaactcaatactaagaagtgatacaacacaatttaaaaaatgagaaaaaaatacgatgagatatttaataagcagagaagacaaatgaatggctaccacacacatgagaaaatgctcaatatcattagtcattagggaaataaaaattgaatgacaatgagataccgtttcgcccccactaaaatgcctgtaattaataagacagataaataaatgttgacaagaatctggataaacatttgaagccctcgtacattgctggaaggaatgtaaaatggtgcaaaatcattaacaaactggcaatttctttaaaagttaaacataaagttactctatgccccagcaattccactcctgggaatcctggcagattcccaggaaacatgcctacacaaagtcttgtatgcagatagtcatagtaacgttatacataatggccaaaaactggaatcaatatacatatctttccatctgctggtgaatatatacataacatgctttacctttaaataacggaatactatttaacaataagatgaagtaaactactgatgcactattatacggataacctcataacgttgtgctaagagaaagtggtctgacataacagaccacattatatatgattccacttatatggaatggccagaaaaggtaaatttatggagacagaaaatatagcagtggagctttgggataggagttaggaacaggaaatataaatgagcatcaggatcttactgtggtgatgaagattctctgaaactgatttatatttatgatggtagaaattgataaatttgatagaaatagttaatatgtagacttgaaatgagagtaggtcataatgtataaattttagctcaaaaaagctgttaaatagaaggatatatattctgtccctcaagtcctctctcctggtcctatgattacaaacaatgggcttttctagatgattttctttctttttatatctatattggttggtatttctgagttgcttactgcacttgcacccaagatgggataaatagaatgcaaatatctcaggcttctcagaattgtgtcttctctatggtgtcgaggtttctaaatattatgccttcccttctatacctttcagaatcttgtgatagctgtttttctattatgactagggttttgggttgtaatttgctggagaggtagggtccgatgtactttacctttactccctactttcattttatgtgttcaatattttaattaataattaatgaattataaatatgggttattatataaacatttttaacttctatttacttttaagtgctttagttttttttttcctaatttttggttaataatagttctttcttcttaaattgatacattttattttattgtaaatatgattgcagttgtcttagactgtttttataattttatgttaatttgctctaagtgattgcctaaacattttaaaagcgtatatattctcctaaggaaaaatccacttattctgctcttttattctgatttactgccttcagctagctaaaatactgcttctgctattatttgttatgtgaacaatccctatttgcatattcccaataacgacttgcaaatatttttactccaaatttaatactcaactgacaacctattataattaatttgcctgtgggcactagcaaaacattcacattgcacgcaattaggtgagagattgtagagtcttgtcatagctattatctcaaaaacacttatttctggatcaatttgtttatatgctttgggcatcattactactattttcaacaccttattaactgacaatttcttctaaggtagtagaaaagtctttgaagaatgtaggtgattctaatagacccataatgattccatacagaagaaaaaaaattgtagcgatatgggttattaaagcgagtgcccaattattgggtgagatgtttaagaaaataccacaattcacagcaaatggactatgcaaggaccttgtctaggaattttatgttatttctaacaaatacaggaagtgatcgaaacaacattaaaattatgggactgagagacaagaaggcaggagaaggtcagagaaaaattcctgcccctaaggccttcattttggggtattaattcttgagccccagtataggccaggccaactaatacactaggcaaaattatgttttaatatgtagtccaatcttaaaatcaggtattctgggtaaacaatctcctttgttcatttaactgcacttgttgcatttttccttccattttgtttagaccagtaggaaatattcactaagtagactacctgtaacactcatttgcattatattgctttagtgaaaaagtgttttaatgttatttgagcaaatatcctctttcattgaataaacattcagaatattttcattagacataattttgaagcagtgatatcaatagctaaggatagaatgtaatgtaacacgcgttcaacagatcgccaagattgtctattagaaaagttttaatcagcttaaatgaatatattatcttccttggataatataactgttatttacaattactgaataacacaattttgcatacattcaccaaagatcatatgatagaagttcatattatttaaatactcatttattaagaagggtttgttattaagaatttcaaaattgtgaataaaggagatcttaaatcacataggaacatatccttgagtcttattttcttggaaaatgtatttaatgtagaaaatagcccgtactgtttttaacattttaaaatcacatcaagttataactgtctatgcctcagccataattacaaattatatggttaaaatattgaacatataaaaatataaatataaaaagtaacaaaatttaacagtatgctttgtttccacattggaagagaaaataaaatcatgacaaaagcatgcaggccacataggcagttcttctaaaaaaagccagtattgaatttttatggtcttaaaattttagcattgagctttataaacttttaaaagaatcttaaagtttaaaaggacattagatagcatctcatatgactatcatattttctagattaagagactgataagagaaacagtatttgcctcaagccaaaatgcaaaacaagtggacctgcaacctaagtctgctgactcatattttggcattttgttgataatataatatattccttttttccacatgcttgtcttcctttttaacaaacctcttcagagtaacagccatttggcaaattctaatggtacttagaccaaatagggtcctctggtttctattgtacttatttgaatgatctaaagcaaaaagacaatccatacattccaattattttgcaaataagaaaatggttattagcactaaaaatatggtatatttaataaacattgtcctattgaagaatatactgaagagtaaatacatgaatgtatttacaaattactgaatagtaaatctccaaaatggaaacactataatagcagcatccattgaagtattttccatctttagaaatttaacactgacatggttactgatactcatacatgcaattatatgatttttactgcaaaattactatattatatacatagagtgttatattttgaaatgtatacacagaataacagcgtaggcattttgtcatggcatcaatacatttaaagactgcaccttaagtatattcatactttcccaaagttcagatctaaaatatgttaacaatttatggttaaatatgtgatgctttttcaccatttttttatattacaaagttttagcttagcatttaataaatataaacattcagaaaactattatatacttctagggtactgggaaataacaggtctatttgcattatgctcacttctccaattacttcacctggtggggatgtatatattttctttgcttggtaatattgccaaactcctttccaggaaggcaatatcaatatagtcctctactataagtacaaatgagtattaggctcaacacaaacttaccagcttggggactgtttacaaaaacaagcaaaataaaacagaaacagattttggtttcaagttgatattagttttaattattttcaatgttcttctagttcttctttagtcatatttcactttatcatatgaacatttttatgaaaaaatgtttatttttgttatttatttacactttacttatgtatagaatctatgtcttctcacatactgttgaaggtgtcacagaattattccctagaatgttcttatggttcctatgatgtgaaatttttctccatacgtcttgcatcggaatcttcagaattaggagccatttactgtcattttttttctgatagagcaaacagctatttcttttttattgtattggaatcaataagatcaatcaattccccaattcaaaaggatatggatttgatctcatttactagctgatttcattttagacgttgtagttcttgcctctgctgatggaggatggacttgtaaaattcacaggttaattgctagaaatattgcttgttgttctcctattatcactgtgtttccagaaaagttatcaaatttactatcttgaaaacctgcaataacttcataagaaggaaagaaatatttgtacctattggctgtgtgtatatgtttgcatttatctttttttttttttgagatggggtctcactctgttgcccaggctggagtgcagtgacgtgatcttggctcacagcaacctctgcctcccaggtttatgtgaacctcctgcctcagcctgccgagtagtagagattacaggtgcccaccaccacacccggccaatttttgtatttttactagagatgggtttttgccatgttggccaggctgctctccaattcctggcctcaagtgatctggcactcttggcctcccaaagtgctggaattacaggcatgagccactgcactcggcctatattcctcgtaattatttttcttattatagtcaatcatttatattaattattacctttaagccaagtaacaaccttattttctctcgagatatgagagaaaactggagtacaatttagctttttttactataaatatttatttcaaattattttttaaagtttgaggtaggaaaataaacaaattttacgtgtatagatgcattattgaatatgcaatataatttacatattaaaatattattttgcatattatattataagaaataagaatatattaaaactgtgtttagtggccagcgttttgtatgagcttcttacttagaaatcatccatgtatgtaaaaattatttcataattaagtaaatcttttgtctaagttcttaaagttccttaaaaatgtggaaatgatagttttagcaaacatgttatacttctattatttgtagcattgtaagaattaagccctgttcttgtgcaaatcaaaatattatgatgacattatttttatatggtaagctacattttaaagaacctaatttatgtcataaattaaaaagaacatcatgctcctttttaaaaaaaaaaatcttgttaccaaggcttttcctctttaccttgtaactatagaaacaaaggctattatgtaaatactattttcactacccacaaaagaaacacaaacctttgaatatattttatttcttttattttgacattatgaatgattatcttgatatcttgataatcttcattatcttgataatcttgatacctagagtgctcacgtaatgacagaagtcattttttttctagttaattcatcttcaaggtttactaatagaaggagaatacaaaatagagatgcgaaaaaagaaacataagtgagatatggtaagcttcaaacaaatacgaatattactgtaagagacaaattatatttcctctgcaagttgaaggtagaaactttagattaaaaaataatctggatatatacattaatggatgagaggcattacagttgttttaaatagtaattcaattttttgacaatttcatcaaaccatcacttaattcctgaagtatggaatcaaagagcaggagtgtctcttatgttaaaccaatgaactctttcatttgaacagaaaagacattcttctctggaggatgtcttatcttttagtcagaggacatctctcaaagttgttttttatatcaaaatgttctcaaaatgccactacatatctaaactctcagtgtttaatatggcttggctctgtccccaaatttcatctcaagttgtaatccccacgtattgagggagggacatgattagattatggggcaatttcctccatgctgttctcatgacagtagtgaatactcacaagatctgatgtgtgtgtgtatgtgtgtgctttttttttttttttttttttgagagggagtcttgctctgttgcccaggctggagtgcagttgcactatctcggttcactgcaacctgtgcctcctgggttcaagtgattctctcacctcagcctccccagtagctgggactatgggggtgcaccaccacgcctggttaatttttgtatttttagtagagacagggttttgctacgttgtccaggctggtctcaaactcctaacctcagttgatccacccgcctcagcctcccaaagtgctgggattgcaggtgtgagctgctgtgcctggcccagacctgatggttttataagaggttcttcccactttgctcctcatactctgtcctttgctgccaggtaagaaggtccaagccttcttccccttctccttttgatagtaagtcttctgaggcctcccagccatgcagaactgtgagtcaatcaaacctctttcctttataaactacccagtcttggacagttctttatcgcagtgtaagaatggactaatggagtaaattgatattgggagtagggcactgctatgaagataccagaaaatgtggaagtgactttggaactgggtaatgggcagagtttggaacagtttggagcactcagaagacagaaagatgtgggaaagtttggaactttctagagacttggtgaatggttttgaccaaaatgctgatagtgatatgggcaatgaaatccaggctgaggtggtctcagatggacatgacaaacttattggaaactagagcaaaggtcactcttgctatgctttaccaaagagactggtggcattttgcccctgctctagagatctgtggaacttcaaacttgagagacattatctgaaattggaacttatgtttaaaagggaagcagagcataaaagtttggaaaatttacagcctgatgatgggatagaaaagaaaaacacattttctggggagatagtgaagcctgttgcagaaatttgcataagtaatgaggagccaaatgctcgtcatcaagacaatggagaaaatgtctccaggacatttcagaggtcttcacagcagcccctcccatcacaggcccaagaggaaaacaaggtttcaggtgctgagcccagggccttgctgctttgtgcagtcttgagacttggtgccctgaatcctagctatgattaaaaggggccaacataccactcaggccattgcttgagagggtgcaagccccaagctttgttggcttccaggtggtgttgggcttgcaggggcacagaagtcaagaattgaggtttgggaacctttgcctagatttcagaggatgtatggaaatgcctggatgcccaggcagaagtttgtcacaggggtggagcactcatggagaacctctgctaggacagtggatttgggaaatgtggggttggagatccaacacagagtccccactggggcacttcccaatggagctgtgaaaagaaggccaccatcctccagaccacagaatgctagatccaccaatagctttcaccatgctcctggaaaagccacagacactcaatgctagcgtgtgaaaacagctgggtgggggctgtatcctgtaaagtcacagggtggagctgcacaggactgtgagaacccacctcttacatcagtgtgatctggatgtcagacatggagtcaaaggaaattatttaggagctttaatatttaatgactgccccactggattttggtcttgcatggggtctattaacccctttgttttgtccaaattctcccacttggaatgggagcatttatccaatacccatatccccattgtatcttggaaggaactaactttcttttgattttgcaggagcacaggcagaaaggacttgcttcttcaggtgagcctttccagttggacttttgagttaatgctggaattaattaaaactttgggggactattggaaaggtataattgtgtttttaactgtgaggacatgagatttgggaggggctggggcagaatgatatggtttggctgtgtcaccacccaaatctcatcttgaattgtaattcctacaatctccacatgtctaaggagagacctggtgggaagtgattggatcatgttgtcagtttcccccatgctgttttcatgatagtgaatgagttctcacaaggtctgatggttttataaggggctcttcctccttcgttcttcatattctctcccctgctaccaggtgagaagatccaagcttgcttctcttttgccttttgccatgatagtaagtttcctgatgcccccaccagccatgcagaactgtgagtcagttaaagctctttcctttataaattacccagtctcaggcagttctttttagcagtgtgagaatggactaatacagtgtggaaattttgacagttagagaaatatgtacgtaagttaatttgttagtgaggaattctaaagtgaacaagtgtttaccttgcaaaaggtatagttttgtcctgagaggatctataagaaccacggcagtctgtaaaaatatacaacttcttatctccagaactttgccaaaggtcgattgtcgcataggaaatctaacaaaatcaacctaaaactaaaaggccccaattgaatattagaacagaattcatcatgaaagtaccgcccaaccatgggcaggttggcaccttgatcaggtagagactcaagagagatcagatgtgttcactcttattggcttgagagtcctagtctaaggccacaaggatcttaatggaatcacagtgaacctccactctgtcaaagatctccagccaaaagtaacctgaaatatacctgtagtcaaacaaatgtggattgattggtttattatagccggtaggatatgcatgtggaactacccaaaaatactaccaagaatttgtgaagccaaaagtgccaccaagaatgtacaaaattccccaaagtagaagcagttctttatttgagattgttgccttgcattttatgtgaaaataaaagtgtggaataaaaatcctgcaaattgcccatttctattatacagatatcaaagacctatttgtagaacagataatgaatagcaggcaagtatgaacttaagaaagtaacaaaaacccaaagctatgaaaacaagtagcatttccgtgtcaggtagtagtctcaatctttttaaaatgtcgacactccagggcatttgaagttttcgcagacagcatactagatattttgttttgttgtttttcactaaacaacactgctagcattttgttcatacatgtgtgtctaaatagtttatatactatagagaatgggggtaactcattaaaataatattagaaataaatgagggactgaatatataaatggatgatggccagtccatattacaaattggaactctcactcacaatctgtagcaactaggtcaggaaataaaaacattctctaaaataagcacccctggaagccagactactagttatagatatatcgatatagatatatagatacagatatatagatatagatatatagatacagatatatagatatagattagatatattgatagatatatataatgtcagactaataggaagtcagaacacaaaccggagcaaaaacccagggaactaagcaataacccctgtaacaatcagcccccaaatatccaggatttgttaataagtaagctccccacatttgtctccactcccaacttaggaccacctagagaatgctaaatatgcatcccttaccaatcacatgccttccttttagttatcttccgacggactccctgtagcaacagccttcaatcagggctcacgtggagccttgccttttttccacaataaatctttcccactcttctgtctgcctttgaatctttatcaaaaggcaagggatagtgactgactcccttgctgtagtatgctctgaataaatagctaatgcttgttcttttcttttcttttctttttcggttggcctttgtctatcttcacaggaagcataagcaaaaagtattatcaaaattgagcttagggtaggtgattgggagaaagttctcaaactcctagcatcaagtaatcctcctgcgtcagcctcccagagagttaaaattataggagtgagccactgtgccacactgggagagggttaaaggaggtgggatgcatagcttgtataaagtataataggagtaattctgtaagtaggtgtattaattaaatctggaaagaaagaatgaaacgaaacttaatctgtaattagtaaagaagcaacaatcatattaaccagagaaagaggtatttggccacttttgttgtttgcaatatatctggtctttagtatgaatatggagttgtcctattgccgtcttgatccatcacagtcacagagtggccttgtctgctgttggtgttcagtgaataactgatattcagtcatagaatattatggcctaagggtggtaggcaggctgggtccctgaaacaccaaggtctggctaatgatgacaggcaaggttctggttactagagctactttttactttctctagactaaatgatttagagacgaagtccgcccctaggagtacttgctatgcgatataaagatggctacccagttttctgtggcacagtatttatctctaatataagaaatacatagtgtaaggcagaccacatatctttctacccgccctctctccatcatcatcttcttcttttctttaaattaattaattatttttttttgagatggaattttcctcttgttgcccaggctggagtgcaatggtgtgatcttggctcactgcaacctccacctcctgggttcaagcgtatctcttgcctgagcttcccgagtaggtgggattacaggccaccaagcccagctaatttcttgtatttttagtagagatgggctttcaccatgttctccaggctggtcttgaactcctgacctgaggtgattaacccataatattaattataataatcaaatcatgaacctacttttctatttcacaatatgtttgcattaatttttttagaaatttgaagtaaattatttctaaagttagaaaatttaatctagaattttttgctgtttgtgaattattttctttctattttttttcttctgctgtgtatccctcctccagagtaatttaactctaattttagggaagtttcatcaaggagtgatataaggtgctattttaaacctaaagattatgccctccttttcccatatacttcgtaaaatattctaaagatattcgtggctaaaaagctatttcaaggtagaaaaatgaactagagaataatttaaaagctgattataggctgggcacagtggttcatgcctataatcccagcactttggaatgccgaggacggtggatcacctgaagtcaggagttcaagaccagcctggccaacatggcgaaacagagcaagattctgcctcaaaaacaaacaaacaaacaaacaaaacaaaaaacgcaaaaacgctgattgtagaaatggaatctaaagaaagaaagaaagaaaggaagaagaacaaagcagggacagaggtttaaaatcttttgagttgcacttatgcaaacatttcctttacaactttatttatatagttaaatggatcctttgcctccttgttgaatcacctgggtccttaggaagacttgaaactagcagtaaggatagaatgttttcaagaaacaagtattacatttatttatgataaagagatgtcataaaatgcagagatcttttaacagacatattgttttttaattacaagtaactaaatgccaacctacagaacgtctactctttgctgcaccagtagatgaaggatcctctgaaattcactcagattcactggtaaataattttcctttcctggagagatgcaattgaacagaaatatgcacaataaaaaataaccctacctgtctttagcattcatattgaaaatatgcttgctatttacagtaactttttaaaaatctgactaagtagtgcattgtgtctgatacccttcattaaaaccaacttccaataagtggaaaacttttagctgtaaaaatgtcattatctttacccactacccaaccaaaatggtgtttacaatcagatttctgatgaatgtaaaacatctgaacttttctgtttagaatgccattatacagatattttggctttcaatggagaccaattagttctatccctctacattcctgagtaaatagaatttctttatcagtgcttttccttcccctgcattttgcagtttgttgattctaaagtgtattttctgtagttatttgtgatatgacatcttggttgctacacagcagttctcagtggttgtaaatcaattccttaaagaaattaattaaaaaatttaaagcagttaatgcagctgaaggcctccagactcatggatcaccagctgggtttacggaagccatctggtatatacttatttttcttttttccttttttcttagtttgcagatatattgttcagtcaaggtccttccttgaatgattcagaatgtagcatcttcctccaaatccatctgaatataggtaagtatagatatgtattaaaaatggagataataaatatcatttggtgaatcattttattacaattattattcattaattttcctttagcttttcctataactgcctactcatttttctaagtctcagaaaaatccaaattttaattaagaaattctcaaacccaaagaagacttagcaacattttttactaacaatcattttataacattgtttcctgtcttaaaatgaaattcacatattccatagcttacctacataagtaacataaaccaaaataatggcataaatataagggcatatatgcccaaaaatatataatcgtgatcagtgtaaacatgagacataattacattaaaggttatattgaagtggtgagatgcctacaatttgaaatagaattactgtaagtggtgcaaatactgaaagatactataataaaatgaagattccatatccgatgtgagaaatttgacagctttcaaattgctacccctctcctttccccatatttgggtaatctaataagatccctcacccccattcacacccctcacccctggaacaaaccctctgccccatgtcataagtcaaaattcaaataacagcagagaacctccatctgggctccattctctaactggaataaaaactccaagccatttgtctccttttgctattgtttctcttcagactgagtctatctcgttggactcatttcctttttactatgtgtgcaataaacattagatcctggcactcatatgtcattacactcaacattcataaatctctggggtggcagaggaggcattctcttcattcagcggagattgccaaataacaaaaaggtacctttgtttactgttggtgatttaaacactaaaagcgactgttgtatcattgtaggtatgtctattttatatagtatatataaagattaataaagtttggaaaaaagtacaattttcccctgatttacatgttatttccctgttacaaaatgttaaaacatagccaaggcttacagaacgcttattgtctgaaaagcactattttaggttccttacattttctcttcacatcaacctgatggtgtcatttatcatcacagtcttacaaataggaaaaccaatgcagagagaagataggaatcttgttcatggttacacagctagtgacaaattcagattttaaatcctaataatctagttctgaaatctttgctcttaacactctaaaattcttagatatttttgatttacatgcaaaacaaagttagatgccagtcttagataatcaatcataaagcagtttttcctccatatctttctgccaggacactcaacactcacacaacatacaataggatgatgactacttcacatgttggaggaaagggccagtcgactgcccattgagcctcactcacctaagatacaccatcctgtatctactgtcctgtgaaataaaaataccatcaagaatttacaaaatgcccaaaggtgggggtagtctctctgacactgttgctttatgtttgatgtgaaaatgaaaatgtgtgctttcattttgcaaatttcccacttacatgatgttggaattaagaatctacttgtagcacagaccaggaaaagaaggagataagtgggaccttgaataagtcacacaaacccacaggccagcattccatgttgatatggtagcctttttacattttgaattgtctacatttggggcatctaaagcttagaaaacaggtggtattttgagaactagatattgtttttgttatttggttttccacttagcagcatctctagcccatcattaagaaatgtgggtctagtttatagaattattcttaatctctttgttctcacatttctactctttcaagtaagaaagttttagacacaagccttagggaatgataaggcaacttaatatgctttattttccatttatttaggctgatgatcaaaggatctatatttaaaatttccaaggcaattaatctcaaatagcttcagagatttttttacttcagaatttttccaagattgcttttgtctaaagtcatagaaatgagaccaagagagagtcaagtctatcaaaacatgtatgtaaagtgtgtatttctctatgcaattttgccatacaggacaaagtgtgttaacagcctgcaaaatagttaagttatgacagaagggaacattagattttttaataggtttattgagttttttaatgttaatgttaatattttctcattttttaatttgttttttcccataggattttgcattctgtaaaaaagttaaactattatttatatttttgatattaaatttaacatggcaaagtctgatttgttcttatgccttacaagacatttttgaaagtcttatactaacttccttccatcagcatatttgacctttgaaggaatagcattttactttggtttttgaataaatttggaggtgagtctctgcattctaatgcaatcactgaatcaccaaagagatactaaagaaaccagggaatgcatcaagaattatttataagcaattctaaagctcatagatacacagttgcaaagttcggagaaataaatgtggcatttatcagtaacaattttcatgccaatgggatagaaattattgagtaaaatcccattgcaaacatcagtccttagctgtcattaggaaaatgctgagaatcacatttcccagctatagtcaattttaacgatattcccaggatcaacttcctgtcagaagatgctattgaaaaagcaagacaacaaagacaaactcttctcaatgggaaattatcttcagacaaagagacattctgtgaactcaacgattaataacctttaactttgcaatgtttgactttgaagtagtgatgaacagaatacagaaatgaaaaagcagaaacaatgatttctctacccaagtgtctttttcattttaaataatttgtatttaaaatcaactttctttccttgactcagcaacttaaaatgtaaagagttgcaccgtttagcaggaatatgttgaactagaactcaagagcactgggcttcaatttcaggattattaggaagtctgacaactattttacctattaagaggtacatgtggatggctatatgacaaatgaagttgctttaaataaggttgtttggttttttgtttgttttttgagatggagtctcactctatcaccaaggctggagtgcagtggcacaatcttggctcactgcaacctccccctcccaggttcaagtgattctcctacatcagccacctgagtagctgggattacaggtgtccaacaccacacctagctaatattttttttttgtatttttaatagagatggggtttcaccaggttggccaggctggtttcaaactcctgatctcaagtcaggatcctctcacctcggcctcccaaagtgctaagattacaggtgtaagccactgcacctgaccttaaaaaaggtttttgatctgttcttggtggaattcctggatgagacatggtgggggtgggaagtaagagtgtagggggttgggtagcatgattattagcttttaaccttggattcaaacagaatagatttgcatttacctattttatatgttgagctgctgcataagctttcatgtaaaacaagttttgataatttacttctcttttaccccagaagtttgtagataatttttctataacaattcctgaaaatgagaataataattctgaatcccttttacagaagcaaaggggttttattaataaaaaacaagggcacaattttaaaaattggctgatattactttgtaaagacttttcatggctctgtggttgatccacttcaatgttttgttagtagatatgaaagttttgagtgttatttgctctttgggtgatggtagatgctgctataaacagccagccaattcagctctgactacaactgctgttctcactagactccaggcacacattttaggagaagtaaattattgaaagcttgtgtgactaggtgactgccaatacattatcccaaaccaacacccccaattctgcattgcacttagtctttttttagtatgatgtttctactttgagattcaaaataataataactgttcttattacagcattttcctcttttcaccaaaaggaatttgatttttatcaaaatcaagggcagcattagaggtcgagctacttggccatagataacagcacgtagggatatgaaaggatactaaaagaaagataatatgagtcactagaagcctttcctatttgctcagagtatctcaggtacaaagagaactagtgattccagtggaaaaggaaaaataagatattggccatgaacacacttcacatactgcccagagcctgatgaccagcctattcagtgccccccatcactggtaaccccatcacctcaaatgaaggactgctgtacaccatgcttgcccctcacagactggaaaccagcctgcctgctgctagccattaccatagaagttgcttgatagagtttgggtaattgttccctccaaatctcatgttgaaattttatccccaatgttggaagtggggcctagtaggaggtgtttgtattatagaggaaaatatttcaaaaccagcttggggccactgtcatagtataagtgagttttcactttattagttcccatgagatctgtttgttagaaagtgcctggcacctcccttcctttcctctttctccctcatcatgtgatgcctgcttccctttgccttccataatgagtagaagcactttgaagccctcaccagaaacagatacaagcaccatgcttttagtatagcctgcagaaatgtgagccatataagcctcttttctttataaattatccatcctcaggtcttcctctgtggtaatgccaagcagaccaagacactgtttctgtgaccagcagagccaacatgtctggcacaagcctctccagagcctgagaaccagcccatctggcatcctatgcccccagcaaagctatgccactgccttcaaaaaaaaaaaaaaggaacaagaacagaaaagaaaagaaaatggcagtctatgcagctggggcatttgcagatattgctggcatagactatagccaaagtatcacaggagactgcataactgcatgcatctagaaccatacccaaaccaccctacccaacactatggaatatatctagaggaaaaagtctcccttaggaatgctagctcataaaattgaacgaggcaactgtttttaccagatgtgcagataacaatgttagggtgacaagaaacatgaaaaagctaggatacatgacattttcaaggaaagacaacagttctttagtaacagtccccaaggtaaaggaaatctataaaatgcctaaaagtgttttaaaataattttgaaatacttttgaatttttaatttttaaagaaactcagtgagataaaaggaaatacatatagatgaatcaataaaatcaggaaaagaataatgatctgaataagatattcaacagataaatatcataaaaagaaccaaacaaatatatcagagctgaagaattcaataaatgatgaaaaaattcagttgagagcttcagcaacagaccagatcaagcagatcaaagacattctgaacttcaatacatatcttttgaaatcactcagtcagacaaaagaagaagtgaaagagtaagaggagaagaaggaggatgacaaaaaggaagaagaggaaaaaaagaagaggaggaagaaatgtttttaaatgaagaaagcttacaaaatttctgggacaccattaagtaaacaagtattcacattaagagaattccagtaggagagaaagatggaaaaataaaatagaaaatttatttaataaaataatacctgaaaatttcccaaatttggggggagatatagacatgcagatttgtgaagctcaaagaatccaaaattgaatcaacccaaaaaagtcctctccaaagaaaattatagtcaaactgtcaaaagtcaaaaacaagaaaagaattctaaaacaaacaaaaatttagcaagccccataaaagagaaactccattagaaggagagcagattttccagaggaaaccatataggccagaagagaatggggtgatatattcaaagagctaaaaggaaaaacatggtaaccaagaatactatactcttcgaagttcttcttcagatatgtaggggaaataaaatctttcatagaaaagctaaattggaggaaattcattaccactaggcaagcctcacaagaaatttcttaaggaaaccatacatctagaaataaagtacaataattaccatcatgaaaacacagtaaagtataaaattcattggtagagcaggtgcacaaatgagaaagaaatcaaaccctataactacaaaaaaaaaacctgcccaccaacctgcaaagataagggataagaaagaaagaataaaaaaaaaaggtatacaaaaaagctcagaaaacaattaacaaaatgacaaaagcaaacgctcacatataaataataatattgaatgcaaatagatagttcttctaatttaaaaatatagactagctgaatggattaaaaaaacaaatcccaactatatgtggcctgccataaactcacctcatctgtaaagacacacatagactaaaagtgaagagatggaaaatgttagtctatgcaaacaaaaactaaaagtaaaaaaaaaggagttataattatatcaaatagtatttaaatcaaaatggtaaaataaacaattaagttcattttataacaataaagaaatcaactcagcaagaggatgtagagattataaatatatatgcacctaacactggagcactcagatatatagagcaaatattactagagctaagaagagagactccaacacaatcatagttggagagttcaacaccctactgtcaacactagatagaccatttagcaaaaaaataaagaaatataggacttaactgcattttagaggatagggacccaacatacatttacaggacatttcatccatcagctacagtatactcattcttgtcatcagcatatggaatattttccaggaatcaagaaaccatatgtgaagtcacaaaataattctcaacaaattttcaaaaaccaaaatcttatcaagtttattcctagactacaattgaataaaattagaaatcaataattaaaggaatgttgaaactatacaactacatgaaaattcaacaacatgctcctgaatgacgaccaatgggtcaaaaaagaaattaagaaggatattaaaaaattttttgaatcaaatgaaaatagaaacaaagcatactaaaacctctgggttacaagttttgtatcataatactgcttttgtaggattaagcagcattaccatgcaagtttataataaatgcctacaacaaaaaggtagaaagattttcaataaacaacctaacagtatacttcatgaaactaaaaaagaaagaacaaaccaaaccctaaattagtaggaggaaataagaaataaacatgagagcagaaataaatggagactaaaaaaatacaaaagatcatcaaaacaaagttattttttgaaaagataaaatagacacattattaaactaataaaaagactcaagtaattaaaatcagaagtgaaaaaaagagacattacaactgacaccacggaaatacaagaccattagagaccaataaaaacaaccataaaccaacaaactgaaaaacctagaggaaatggataaattcctggacacataaaataaaccaaaattaaaataggaagaaataagaagcctaaacaaaccaataaatagtaatgagattgaacgagtaattaaaaagacttccaacaaagaaaagctcaggaacacaagaatttatttttgaattctaccaaattttaaaaaaagaactaaaaccaattctatcccaaaaaacttgaagagaaggaactcactcctaactcattctacaagtccagcattaccctaatgccaaatcatacaagacgacaataaaaaaagaaaaccaaaagccaatatgcctgatgaacatatatggaaaatttctcaacaaaatattatagaactgaatccagtagcatctcaaaaagataatatgtcataatcaagtgggatttgttttagggatataaggaggaatcaacacatgtcaatgaataaatgtaatacatcacattaactgaattaaagacaaaaatgaaatgatcatcttaatagatgcagaaaatttgataaaattcaacattctttcatgataaaaatgtttaagaagttaggtataggaaaaaaatacctcaacacaataaagatcatatatgacaaactcacacctaaaatatactaaataattataagtgtattagtccattctcatgttgctacaaataaatatccaatactgggtaatttacaaaaaaaagaggtttaattggcttacagttctgcaggctgcataggaagcatagcagcttctgctactggggatgctttaggaaacttactaccattgtggaagatgaaagggcagcaggcatgtcttacatggctggagtgtgaggtagagaggaggggaggtactacaatatctcacaagatataaggaggatcatgttaaatcattagaaactgtccccatgattcaatcacttcccgtcaagcccctcctccagcattagagattacatttcaacatgagattttggtggtgacatagatctaaaccataatgagtatgaactggaacaagacaatggtgtccactttaccctctattattcaaactagaatttgggaagacctagccttagtcaagagaaaaaaaaaaaagaatatccaaattagaaaagagattgtttctgctggcaaatgaaattaccttatatatagacaaatcttatgactctaccaaacacaaacaaacaaaaaacttctgaaagctaatgaacaaattcaaacttgcaggacacaaaattatcatacacaaattagcaccatttttatacaccaatgagaaactagttgaaaatgaaatcactaaaataaccttatttcgcgtagctacaagaaagaaataaagtacctaggaataaatttaattaaggaaataaaatatctctacaatgaaaactacaaaactgatgaaaagaattgaaggacacaagcaaatgaaaaggcatcctatggccatggattaaaaaaatgactactataaagataatcatactgtccaaagtgatctacacactcaatgctatccctatcaaagtactaatgccatgtttcacaaaaatagaaaaacaattctaaaattcacgtggaaccaaaaaggggcccaaatagccaaagcaatcctgatttaaaagaacaaaccgggaggcaacttaatacctgaattcaaattatactgtaaacctacagtaagcaaaacattatggcattgttaaaaaagatacattaaccaatggatccaaatacataatccaggaataaactcatatatttacggccaactgatttttaacaaagacgtaaagaacatacaaaaagggaaaaacactctcctaaataagtcgagaaaactggatatcacaagcagaagaatgaaactagacctctacctctcaccatacacaaacagcaactcaaaatatattcaatatttaaatataagcctaaaaattatgaaattatcaaaagaaaacataggggagatgcttgagaacattggtaagcaaaaattttataagtaagacttcaaaagcacagataacaaaaatgaaactagacaaatgagactgtgccaaactaaaaaacttttgcacaacaaaggaaaccatgaatggagtgaagatatgaccaattgtatgggagaaaatatatgcaaactattcatctaacaaatgataaatatctagaatatacaaggaactcaaacaattcaactacagaaaaaaatccaattaaaaattggctaagaatctgagtaaacgtttctcaaaagaagagatacaaatgatcaacaaatatgagaagaaatgcttgacctcattaatcatcagggaaatgcagatcaaaaccatgaaaaatatcatctcaccccagttagaatggctattatcaaaaagacagataactaatattggcaaagatgcagagtaagaagaatcttttatacactgtaggtgaaaatgtaaattaatacagccattatgtaaaacataatggaggtttctccaaaaactcaaaataccagcactttgggaggccacggagggtgcatcacgaggtcaggagatcaagaccatcctggccaacatggtgaaaccccatatctactataaatacaaaaattagctgggcatggtggcacttgcctgtaatcccagctactcgggaggctgaggcaggagaatcacttgaaccagggagtcggaggttgcagtgacccgagattgcaccactgcactccagcctgggcaacagagcaaaattccgtctcaaaaaataaaacaaaacaaaacaaaaaacaaaactgaaaatacaactatcaaatgattcagcaatctcactgctgcatagttagccaaagaaaagaaattagtatatcaaggagatacatgccttcccatgtttattgcactactattcactatagcctaaatatggaatcaatccaaatgtttatcagtggatgaatggatacagaaaatatggtacatatacagaatgatatactcatcaacaggaataaaattgtgtcctttgtggtaaaatatataagctcagaggacatcatgttaagtgaaataatccagacatagaaatacaaatactgcatgtattcattaatgtgtgggttctaaacaaaagttgatgtcataaaagtagagaacagtgttgttttctttagaagatgagagggctggaggagaggagattatggagagaccagttactggatacaaaattatagttagacaggaagaataagctctagtatttgaaagcactataaggttaataaatttaacaataatttaatatattttttaaaaaagctagaagagaggattttaaatgttctcaacctataaaaaataaatatttgaggtaatagagatgcgaagtagcctgatttgattaccactcaagtatacatgtgttgaagtatcactctatatcccataaatctgtgtcaattattgtcaactaaaaatgaaaagtaggtgaaaaagaagacagaaaagacaatgggagacatatgaaacataagaggaaatactgtgatcaggttttcaataagtacctcaaaagtcagatttattgtataaggatctcctgtccaaaaaaaccacacataccttaagtgcctcctgtatataatccaaaggtaaatggcatgctatcttcgttctcttgatgaagttaccactctagtatagaaagtgactacttttattaaccacaatctgaactttttctctaagaagcaaacacattaattttatggataggcttttattagttgaagagggaaatgtaggatttgacataggatatgtaagatttttctaggaagcctttatgtttactgcctgatttgaataaaaaggtattttacctcttgccctcctttacaattgtcagcaaaatgaatgaatttcaacacatctagataatttggttttagggagtaagacaattaactcattttttcacattttgttgctgtttataaaggatggccctttttaaaactttttagctacttcatagaatatcaacttgaataagtctttactttttaaagttagtcgtatatagagcaattgcaaaaataatacagttaactcccacacactcctcacccagctttccccactgctaacatctcatatagccataatacaattatcaaagttaagaaattaaccttagtacaacaccgctagttaaattacagaccttcctcagatttcatcagtttcaccactaatatctgttttctgctccaaaactcagtcttggaactcacattgtatttagtggccctgtttccttaaatttcctccaatctgttcctcggtgttaccggttgaattgcctgcctccactggccctgaggcaacccattcatatattgaagtcctaaattccagaacttcagaatgtgaccttattgggagatagggtttttataaatgtaatcaagttaaaatgaggtcattagagtagaccttgagtcaataagaccggtgtcctcataagaaggacaaatttggacagagacatgtagagggaaaatgatgtgaagacacaaggagatgagggacatctacaaaccgggaagagagaggcctggtacagatccttccctcacagctctcagaaagaagcagccctgatagcctcttgattttggactcctacactccagaaatttgagacagtatatttctgttgtttaagtcaagaaaagaaaagttaactttatatctatattctattattatattaggcctacagttcaaaacatgcaaatgtcttttctgattaattgcaaagtttggtttcctagatcaatgctctacatgaggagcagattacttttaaacattgttaattcactattgatcactgttaaactctgtggcacctagtggagaaactccggtagaataatttatcagtgtttctgtctattataaagtttttaaaagtctctattttgcaactgctgtgtttgagttgcttatgttcaatatatcctccacttcaccctgttactgataccttgatacaacttggattttactgaacctgttaacagtaattttaagtggcattattatgagttttttatgtgaggctttttcttttttaatgtgtattttagaggtctattctattcatggatgagtttttcatctgcccccaactctgtaccctctgcagtagaaaatagcaatgaaggattattttctacatgaagaagacttaattggtattaccccaaacatagaatatcattgttatgtagctaacttggcctttccttcaaccataggcaataattatctgagtatacttcatttgagtctctgacataaaaagatggcctaagaaaataaatcttccccccaaaatgaaaattcaacaatgcaataacacttacaaaattattcccactaaaacatcctcctacattttactcatgattattctttaaaagatatagtggacatataaaaattcaaagcaaattaatattaaattagaaatcctaaaaacatattggattttattaggtaaataattatgtaaattaatgtaaaattaaaggattttaagggactctgaaaatgtgatgaaccactgaaacattttacaaaatgctctgatttctttcactgtaatatttttatcacaaaactaacacatacattatgacctactttaacacttgttatcattaatgtaataatcaattactgactcccccaaataaaaaacctgacaagccttcttttgaaaatgtactttattctccatatttggtcacttttcacgtttattacctctgattttttacctctaattttttcactttttactttcaccactgatagtattcctggtcagaaactaatagactatagcctcatctgtgaaagtatttgctagccttcttcaacattctcaaagaatccttctatatacctcaaatgtagatttttattatgttgtttgaaaagagtttacaattctccctcactaaattatgctttcttgaattgtacaaaccacattttgtttataaaactattctagtgtctatgaacatttgtctttcacagaaatggttgtcaaaatatgttaaaataacaatttaggttagaatagatacaaaagaaaaataacttccatattaataaagtgggaaactgtgttaatttccaacataaagttcatttaaaaaatattttggtttttgagtctgactttatttattttagctgtagaaagacttactagatccaagtggatttagaagtaaattatttcactggggatgtgtaagctgtgagtgactgctgttagcagtttggattgaacacaaaagacataaatatagtaataacttgattaggaggtaagcagaagagaaaatagaagtttgttttgtatttttgtgtgtttttactatgatgtataaaattcttaccattcaaaaaaaaatcacaaaacttcgttcaactgtagattcctgctgaaattctagagtaagcaatgggcctttcattatgatttcttccctcaaatcagtttcctgtgtattttgtaactgtgataagtttcatgtctctctcaactactactgctttcaccagtgttataaaaaaaaattgtgtggtatataaattcttatggaaatgtagtactaaaaaaccaatgaacttttttactatgggaaattcatcctacataggattttcagaatcttattagctagatatatcaaccctggtaaatgattaatccagtatatggggagccatataactaaactctcaaaatgcaagatacatagaatttaggaaatgtatgtctttatgcttaaggcaacttcatttactaacttttcaaatttgtcctagtttttacttgaacaatgttcaaacattaaatgtgtccccaactcaaatacatacactagcaggaggatttagccttagagtgccagatgtcttagctgattctggacctatttataagtcataaaactatagaacttctagaagaaaatctaggagaaaattttttaactattggattaggcaaatgttttcgagggacacaaaatcaccaactatagaagaaaatcagtgataaataaattaattcaaaattagtaattattattccttgaaagataaacaaatgaaaaggaagccacaggctgagagaaagtattttcaaaacacatatcagttaaacaacttacatccagaatatattatgtactcttccaactcaataagaagacaaatgattcaatattaaatgaataaaagatctgaaaaaaatacttcactaaagtagataaatggatggctaataagcccttggaaacatgctcaccatcactagccatgaaatacaaattaaattaaaatacaaatcacatgcaaattaaaaccacaattaaatatcactatgtacctattaaagtatcctaaatttaaaagtatagctatagtaagcaatgcaaattcttatatatcattgagatttagaaaaaagatacagcctacttagataacagttgaacagtgtattacacagttaaacatacaatcaccatgtgattcattgattcctatttttgatatacatacccaagattaattaaaacatgtccacacaaatacttataatcaaatttttatataattccattcacaatcactgcaaaataaaaagtttaatgtccatcgtcaattcatgaatggataaaaaatgtgatatatccatcaatggaatacaattcatcaaaaaataaaaaaaaaactgatacacaagtgacataggtgaaactcaaaatcactttgctttttgaagaaaaaagatgacaaagagtatatactttataattgctatagtttctttacatggaattcaagaaaaatcattactacagtaaaaaaaaaaagtggattagtagtttctaggtagacggggtgcatacatttagtgatcttggctacacagtaacagttacctgaaaatatatttgtcaatagcatttgaattataagcttagaaaagcgtatttccttttatgtaattaaagctcagatctaaaaatactttaacaatatataaaacagagttggtaagcaggaatacaaacatagaagaatcaaattattcatttgggtacaatttagttgtgtattttatttatcatgtctaacttgtgaaataaaaagaactaaattacatgacaaaatagctcacagggtaataaaatggtataattttatttttcatttatcatttaggagatggattaatatgttgcttattggctttgataagttaaatactcatgataaaatttctaagacaaatactaaataataaaaaataattacataattactaccacctaaaatgggcacatgagtagaaaaatatagaaaaaccaaacacagaaaatgatattttaagagaatctacatagtttcattatcagagtgaatttaaatagactaattgtgtcacatgaacaaaataattatcagattgcatattaaaatctaattatatgctatttataagatatacactaaaatcatgagactatagaaagtttgaaaataaaggcatgaaaaaatatgagaacacaaaacaaagcaaaacaaaaaattgggggctgttactctaagataaagcattcaattaacaaattaagaaaatgataaaatagtctaaacaatatgaatcgacaataaatacaacagtagagaaaaataacaaatttgtcattatgtagcaggatgagctgcagacaaaaccccttagacaccgagttgaggaaggaaagggctttatttggctaggagcataggcagacttacgtctcaaaaaaaccgagctcccagctgagtgagcaattcctgtcccttttaagggcttacaactctaagagggtcgtgatctattgagcaagcagggggtacgtgactgggagctgcatgcaccagtaatcagaactgaacagaacaggacagggattttcacgatgcttttccatacaatgtgtggaatccatagataacataagcagttaggtcaggggttgatttttttttttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaatttttttttttttttttgtatttttagtagagacggggtttcaccttgttagccaggatggtctcgatctcctgacctcatgatccacccgcctcggcctcccaaagtgctgggattacaggtgtgagccaccgcgcccggccaggggttgatttttaactactaggcccagggcgtggcgctgggctgtctgcctgtggatttcatttctgccttctagcttttacttcttctttctttggaggcagaaattgagcataagacaatatgagaggtggtctcctcccttaattatggtatgctattgcatcacagttcttccaattttgatgttgctatggtttgaatttttccctcaaagttcatgtgttaaaacctaatccccaacacaactttaagaggcgcttaactcatgagggcttcagccggatgaactgattaatgttgtttttgtgggagtgggataaaataatgagtttggcccccttcccacaagttctctaattcttaccttcttttgcccttcctcctttcacaatgaaatgaagcagcaagaagatcctcgccagatacgtgggcctcttgaacttggacttcccagcctgcagaatggtaagaaataaatgtctttcttctggatcaaaccaatcccctgagccctatgcaaatcagacaccacctcctccagcctcctcatataactggctaatttccgctgcactcagggttttctcttcattcgaatccctcttccctctgcctctgtatgggggagctgttttcttcttccttccttctttcttgcctattaaactttttgctccttaaaaccaaaaccaaacaaacaaaaagaaataaatgtcttttctttgtagattacctagtctatagcattatgttattacaacacaaaatggactaagaaagatgttttacagacaaaaattcaataaaaacgtaaagttttgaatgacacaataacgactttcatttattgagatcatgtagaactataaacacaataatgtgtgaattgcttgagcacatatagaacatttgcaaacaactggccacattctaaaataaaaatctattttcagtaactattacatgctgacaatgatataaaactcatcctgtaatgataatacaagtaaatttaagtcaatcaaaatagaaaacaaaaattatataaattgaatgtttcaaagcacactgataaaaatctcatagttcaaagaaatattagttctatgagaaaaatctcatagttcaaagagatgtaatttataaagcgattagaatttttatatatgcatatcgataaatgtaatagtgacaagggtactcaaaagatgattattttaataaatgcttaccataaaataatgtgaatgttaataattatttaaacttaatatataagcaaaataacaagaaaaatgattatattgcaaaagaaataatacagaaaacaaaaacataatagaagatgttggcaaagccaaagctgattatttgagatgactaattaagttataatatcttttcttgaagataattgagaaaaatgagaaggtaaaaatgaaggtaatgatttaaaagacaaaacattggtataggtctaacaaaggtttaaaaatataatactaagaaaattggtatggtaataaatttataacttagaagaaatggacaactttctaggaaaaattctttaaatgttttattttaatcattaaattaattaaatcattttaaaacatatttcttgaaacaccaactgatatgatatttcacatgaattttgtcaaaatgtcaagaaacaggtaattcttccttcaaataaataagtttgtcacagaatatcaagaaaagaaaatattactagctttctttccagaaactgaaagctatcttaatatatagcagtttctatagctgaccacgtaggcaactctgtaactttctacatatatatcgaatgttattttattccaaagcagtatttatcagtatacattcacaataactaattatacaagatcttatttcatattctctcccaaactgggtattaacacatatcttaattgtagccaaactagtgggcataaaattctatcttatggtgatctcctttatcatttcattgattacaaatgaagttaagaacatattttcatgtgtttattcatccttttactcttattttaaattataagtcctttcttttgcttgtttgtactttgttatttttcttttatttgatccacaggaattctttctatatattggatcctaagtatttgttggttttagatataacaagtatcttcttttagtttatatcttacaactgtgacaggtcagagattttactcaagttgcaaggtcacatgttagcttgccacagtgtcctagatgttgaagaagacaaaagattcctaagagtaatgagacgttatcactcacagcacagcaaatggcatgaatatcagtatatttgcatcggctccccttgccctcaaattctaagagagtgaagagatgggtcaaggtacataccatttgcagagtgggtatgattcacagctgaagtacccaggttaaggatccattacctattcaccaaagagtgaacattgcagacgagtttactgctgtctacaatgttcactctttggtcaataggtactgggcccttagccctgttaatacccagtttgggggagaatatgaaataagatcttgtataatttgttgttgtgaatgtatgttgataaatactgctttggaatacaataacattcaatacactctaatcctgcaatattgttttacagtcttggaagcatgcagtaggggacataagatagattattaatgcaatgcctttcataagggagtacactgaatataactcaatattcattgacagaagggagtatggatactgcactaaataaatattttacagctatgatattgaacaaactacagcaacattcaataacatgagtgaatctttagaaaaataaattttatagaatagtatgcttctataaagtccaaagctagcaaattttaaaaataaaaatatgtgataaattattaaattcatgccgtagttccaaaattcaatatagttgtttggcaacagtgcagagagataacatttgcagctgtatacatatatagccaaatttattggtaagattccatttaggtatggtaatgtggtcatggttatttatttgtgttatgttttgtaatatataaatatacattattcttaatcaaatattgcatattgaaactttaaactgcatatgataaatcaaaatgtaagtatttgtagtacaaattgagggaaaaaaacaagttcataatttaggtattaaaagcagtttctgaaaagtctaagttggataactatacaaataatttcactcagctcttgaattttctaacaatatatttagttttcaaattccaggatacttttttgctcagtcctgtcaagtccacagcttttgtttaatcatataaaatatagaatatcttctcctgttccaaaaattatttaggtcctactttgagcagtgaactctaattgtttaagtattttaaatatattgcggatatgctgtgaagtccaggctgaagctgtgttttactctgaaaggaagtactagattcactctctctacaagctttttttattaataaaatatttaccaattttagattcatgttttcttagacaaaatacagaaacagtagtgtacatatctctaataaaaattgtaaatgtaagttataaaatcctattactttttaatattatcttcctgaaaagagtatgatttatttccccataaaccatccatatttattgtctttgtattgtgtccagtcttgcagaccagaatagagtgagggaaatgcattcattaaactcatcctgagttcatagaaataagagttgtcagtaatttcacccattgacttagacgtgagttaagtttctttcacagaatgaatatatatgaagtcatatgtcatttaatgatagggtagggatatgatctgaaaaatgctttcttaggtgattttattgtatgaacatcatagagtatacctacataaacctagatggcatagcctgccatacaccgaggctctatgttatagcctattgctcctagactacagacctgtacagcatgttactgcactgaatactgtagacaattgtaacactatggtatttgtgtatctaaatatataaacattaaaatggtacaagccagatgtggtgactctagtttgtattcccagtgtttggaaagccaaagtgggaggatctcttgaggcaaggagtgtgagacaagtcttggcaacattgtgagactccttcatctctacaaaaaaaaaaaaaaaaaaaagagagagaagaaagaaaaaactaattggtagagtgtggtggtgtgtgcctgtagtctcagcttttgggtaggctgaggcaggaaaatctctttagccaagaagtttcaagctgcagttagctgtgatcacgccactgcattctagcctgggtgacagagtgagaccacatttcttaaaataaataaataaataaaaaggtatagtaaaaaataatacatttttaatataccagtggtcctggtggcatggaaccagtattacatatgaggtccatcatagactgaaattttattatgtagcacatgactatatatattcttccctaattctaccttctatgccttatgattcacaaggaaaaaaaagagcaataagttagcattgttctcaaaatactggtttctctttcaatatgtttcaacaaattagctataatccgctgtaagtcaagcacggcaagtcgttaattcttgttaattttccctcagattaaggtaaaatacaaatttcccaacttcaggaatttggcccaaccacaagataataacaaaaacattaaaaatgcatattttatgttgctaagaaaaaatacctatgtcacaaactttgtatacaagaaatcttcccagaggagagttttgtgaggattttcttacctataattttctttctatttcaaataatctgtgtttgttattttgtgtcatgcatagtgagcatatgaaccagaaaactcatattttttgtttgttttttgaaagtaagtctttattagcctgctgtgggaaacacactacattctacattcttttttttttttttttttttttttttggaacaaggtctcatactgttgcccaggctggagtgcagtggtatgatctaggctcactgcaacctcagcttcctaggcttaagcaagcatccagcctcagcctcccaagtagctgggactacaggcgtgcagcaccacacatggctaatattttattttttttgtagagagggggttttgtcatgttgcccagactggtcttgaactcctgagctcaaagcaatccacccgcctcggcctccaaaaatgctggggttacaggtgtgagccaccatgcctggccttctatgtttctttatctctctacttaccttcaatatttctttgcttgttgagtgtaatgggcatgtagttcttttagagattaaccgctggagtggataagtgttctttgcaaaccaatgaattctgggcaagtttctttttactcagctgtttacatgagtttgatggctaatttttggtgtcaagctgactgaattaaggactacctagatagctgataaagcacgattcttgagtgtctctctgagggtgagggtgtttccagaggagactggtgtgtgagttaaaggactgaatgggggagatcagcccttaatgtgagcgggctccatccacttgcctggggaccagatggaacagaaaggcagaggaaggacaaatttctgttctgtgtccagaagccaggacactctccttcctctgcccttggacaccagtactgaaggtctctgaccattgaactctggatttgcaccagtggtcctctgggttctcaagcctttaggctgtgaccgagagttacaccacagctttcagacctggactgagccacattactcactttcttaggactccagtttgcagatggcctattgtgagacttctcagtctctataattgtgtaagctaactcacctaataaggcccctcttatctattatctatctatctatctatctatctatctatctatcatctatctatctatctatctatctattatatcctattggttctgtctttctggagaactcagggtaaaacaattagtcaaatacttctcttcaagacaaagtggtacatttactatgaatctataatgtaggtctaggatggtaatttttaaatgactgtgtgcaaatccctcaaggggtattatgaaagaaatattctctttattttccatttattctccttccctctgaggatccacattgacttaaacgtatttgcaatagcgggaataaagaagtgtgcctgtggtaattctgggtggggaacacttcctgtcaggcttccctgtgataacttttgcatttctggtgaacctcatgctaggttactgctcatctgtgtaaatgtttcccagtttgcctgaaaagttacgtaagttgccttttcaaccatgaagtaagattacttcaagatggttaaaatagttacagaagtttagatttaccttataacagtaattctttttttactatatagaattaaatatatatatatgtatatacatatatttgcaaaagctgatttactttagtgtgccatttataatagaacatagtaattttcagtggttttagcttttcagttttgattatataagagaggaaaactagactatgaccttcatctttagtgttaactacagattccctaaccactcttacaaagggagttcagtcaaattgcctagtttacaaataaatccatgaaggcgtttttaaactgcgttaaacactttgaataaaagtatgattatggagggttatttacagaaaaactccgtgaaactgtgttttcacagtttcctcacaccacaacaaggaggaagtttcctccttcctcacaccacaacaatcgtcaacacagaagatttttatgagcaaatgtattggggtttccccccaccaccaagcagtggacaccaactgggtgtcttccagttcaactctgacactatctacctggaaatactgtcagatcccacaggatgagggctcagtccccaagactacctccccacagacatcatcacaagtctgggcctctgaaacttctgactgactggcttcaagttggggttcctacaataccctctttgggtttgattaatttgatggagcagctcacattactaagggaaacacttatgtttactggtttattataaaggatattacagaagatacagatgaagagacataggaagtggtatggggaaaggggtgcacagcttgcattggcccccctggggcaccaccctccaggagcttaaacatttagtcgaagctccccaaaccctgtcctctagggcttttatgagagcttcactacgtaggcatgactaataaccatatacaaatgtgattagacaaaaaaaacgcaggatctagacctagcgaggcctgtctgttctgacttttcttggcctctctgtgtagcattccttctctagggtatggggcaggaatctccctagaatggggggtttttgacccacaatcagattacagtcctgaggtgaaagagaacaggaggtcagaaacagagattctatttcctgtggcctaaagtgcctcaacattataacaaaaactgtgggagttagaagccaggaaggatgaaaatctataaataaataaatatttttatatctatatctatatctaatagcaccacgaggggagagagagagaaagagagagagaaattttaacaaactagctaaactgtcttagaattccataggacaaaatatcaaattttcctttgtaataaaaatgacaatactatattagagtatgagcataacatctaaattatacagacaagcaccataaaatacctatacaaaggaaaaacaaaagaaccacacagagtcatagatttgtttcaaaactatgtttagtgtcaaggatacagattgctttttagcattttggaggtaacttcttgagatctgtgagtttttaaaaaaaacatgatgttatgttgtagcctatgactatggttccaagcaaggatcctggtctaattagcaaaaaaaaaaaaaaaaaaaaaaaaaaaaggactggccgaagcaatcaggcccactcctgaggaatgctgaggaatgttccctcgacactccttcagcaatcttttgcgatatgatatagcagtaaaagccaacatggagtagagaggacagaattactcttgcgtttgaaaccgcaaacagtcccaaacaaaacacataaaacaacaaatttcaaaacactagacatcaatcaatgaagaatagtaattcctgagagatgacacacacacacacaaatggtgagcccgacaattgctgcagtgtgttgcattgagagaatgttcgcccacggtgcagagaaggaaaacttaaggggaaactagaaatctctcatcttatgttgagaagatggagttgagagttcagggcaatcaaggcacttaatctcataagacagtgtaccagagaaaagagaactgcacatagagagaatcccagagatctgcagatagtcctccttgagtatttaacagagtactgatcagcttacatgtgtgagcaaactaccttaggataagagagatcatccaaaatgattacagaaaacagtgttggggactcacgcagggccaacgacagtacctgttctatcttggccacattggattgaaaaaaatcatcaatttataggattttgcatagagtatttaggaaaagtccttcttcagtactgaggaataattaaccccacactgagcattgcttcagaacgctttaataaggaatacaaacaatccccgaaaagattaaactgtttacaaatagcatctcaaaacaaagctcaagaaaatgtatgggcatacaaaatatctagcactaccaagttaaattcacaaggtctggcatttaatcagagattaccaggcatcttattagaaaagtaaaagcaacacataataacgagaataataaatcaatcaaaactgatgcagaactaacacagatactagaattagcagagaaggatattaaagcatttattttagctatactccataggttgaaaaagttagagacaaagaagatataaaagagaattaaattgaaattgtagagactacaatgtcaagataaaatataactggatgagactgaccacagattagattttgtaaaagaaaatataaatgaaatttaaggcctagcaacagaaactaccaaaaatgaaacacagagggggaaaagaagaatctacaacaaggaaaagactacaggctctggaacaacttcaagcagcctgatttatgagtaattgtatccccaacaaagagggggaaaagatgaactaaaaagatatttgaagaaataatggctgaacatttccaagcttgataaaaactataagcaaatagatctaacatactcagtgtcttagtccagttttctattgtttattacagaacacctaaaactgggtaatttataaagaaaaaggcatttatttcttacaattctggaggcatctggtgagggccttcttgttggtggggtctctacagagtttagaggtgatgcagagcatgccatgacaagagggctgagcgtgctaacgtgcttactttgttctctcttcctcttcttaaaaagccacaggttccactcccatgatgaccaatctatccattaatctatgaatgggttaatccattcataatgtcagagcccttatgatccaatcattaggtgatccaatcacctcttaaaggccccagcttttttttttttttttttgaaacaggatcttgctctgtcacccgggctggagtgcactgaatcctcaaactcctgcgctcaagtgattctcctaccttagcctcatcagtagctgggactataggtgcataccaccacacctggctattaaagaccacagctttaatactgacacattggggattaagtttccaacacatagaatttcagaaacacagtcaaatcataatatttagtaaaactcaaggaaatatgaagaaaactaagcgatgatatatcatgataacatttcttaatataattaataaaaataaattattaaaagcagccataggaaaaaatattacatttagaggaacaaaaatggaaatgacaccagatttcttgctgtaaacagtacaagcaaggagttggtagagcaatacctttaaagaaaattttttttaaactatgaacctagaattttataacaggaagacacatctttcaaaaatgaaggtgtaataaagacattttcagatatataaaaattgaaaaaatttatcaccaacagtctcacactagaagaaatgttaaaggaagtctttatgatagaatgaaaatgttaacagataaatatctgatctatccaaagaaatgaagagcactagaaatgttacaatatgggtacatgtaaaggttgtttttccttattatgtaagtctctatgaaagaaaaagagactgtttatctggctgtttccacaaaataatagcatattcttattcaataataatgtacatagcatatataattacatgtataataatacatatataattaaagatatgataacgcatatattacgtgtgtaattataataacaaggtatttcatggcgtacaacatacataaatttaaaatgcatgcgggagctatggtcattaaagcatcatgttattgtcacaaagatggacaaataagaacagaataaaaaatctagaaataaacccacacgtatatagaaaactaatttttacaaaggcacaaaggtaatggagacattataggctttccaataaattgtgctgggacaatcagatattcatacgcaaaaaatatattttaaaataattaattttaaaattaattttttaaacattaattaaaatagataatacacctaaatttaaaatgttaagttataaaacttccagaagaaagcttaggagaaaatttcacatgcttagcttaggcaaagatatcttggaaacaacaccacaacaccaaaagcacaatctataaaataacaaattgctccctaagctttcaggtattttaacaggcctttggctcagtagaactctgtctcataaatatctccatgcctacctccttcatctctaaaattcttctcaaccacatgttttccagtgaggcctgccctgaatacgttgttttaaattacataccatcctctatcccacagcacttctaataactgtacctgctctgttgctctgtttttcccatggtactttaccctctaacctattatctaatttgcctattaactgtgcgcgtcattattatttactactcagttaaactgtgtggtgcacagtagatacttaagaaatatctgttagcaaaatgaagagaaccaattgtccaaaaaacaccccaaatgttaattggttgcccctggggagcaggaactggagacagaagtgggaaggtagaatactgtataagtatttgcaaatgacttgatgattaaattagatacattattatgattatttaaaacttatttttaatgaaataatgatgacttattattgcttttaatcaaagcaacatgcatcccaaatttgttgttttctgctttcttgtctaagcgttgctgcagtagaacaatactttcttagaaaacatttcactgtggtcatcctgttatttatcacccaaactgggagctttggagatttccagatgacaaactggatggtactctcagatccaggcaccaagtgggattctgctctgtaaaactgcatgccaatgatccacaggaaatgttgagattctgtgtacttgtagttgagcatagatttcaaacagatgaatttttgaatgagaagaaacagaaacactttatataggttcaaatcttttaccagcaattctgaagtcagaaaagaagttctgaaaactgagaaggctttaagtctgtattatggcaaaaccaaaaaaagacctgagcacatttgttgccaaaacccttgaagtctttagtcagtccacttagtatgaatgttcataaattttactgcagaaacattaatgcgcatgaatattgttttctgcccaggcaaaatattatgtaatatacattctaaccaattaattatctttttaaaattagaaaaattcaaaattctgaaacaaatctgatcccatatatttcagttaagaaattgtgaacttacatatatttttcctaattatccttttactttaggattttgtgggttaaaatggaaggcaacatttttaggaggaaatggggcatcatttaggtcaagtaagcctttcattgatggttgagacatggagaagagaagatgctattatttagcacttgatctggaagcgagtggaagccaccagatccccattgcagggagagtatggcaacactggaacttcagagccaacagtgctttatttaggaagctttatattttacaaacttttattttttaatgttctcagcctttttttctcatatagatgttcaaaaacaattcctgtagcatcaacctgaaaaatatatctagtataataaataaaaagattctagaaaaaaatgagtaacttactcatgtataggaataataatgtctttcttaactgggcagcgtgattcagtgaagatgaaacttcctttttatgttgttgttctctgaatttctgatattttcatgtcacttcaattctctctagggcccgttactgtcagattccggcagttgaccctggtgatttcacagcagcaagcactgcaggcgttcccaacacacaaggcaaactctgtatatgggctcaccacccacagatccagctgtctgtcatgtcgttcccatattgaaggaacataacctgttattaagccaattcagccctggaagaaggaacaagtttccaaaatgcaatctttgagtttggaaaatggcatttgagaggtataaataaagctaaattcttatagaacttaaacagcattgtggttattatgtattttttaaagaaacattttttctttgaatttttttttaatgtttatagcaaagttgcaaagatagtatatagtgtttcctaatacccctactaagttttagtttccccttctgatgttgacttatgttaccacaggacaagtgtcaaggtaaataaaccaatattattagtacattactattaactaaacttcagactttcttcattctcaccagtttttctatcaatgtcccttttctgttcttggatcctgttcagggtagcacattgcatttagttatcctgtctcctaactctcacctggtctgtgagcatttcttagtctctctgtgttttacatgacctagccagttttaagaggtactggtcaggtattttgcagaatgtctctcaaattggggtgtcttatttttttctcatagttagactggagttaatggggttttcagaaagaataacactgaggcaatgtgtcttcttcattacatcatatcaggggaaaatgcggtatctcctggtgatgttaaccttgtttacttggttaaagtactgtgtgccatgtttctccactgcaaaatttctcttttcccttgctatattcaattcttttaaaatgagtcataaatacagtccattctctaaagaaggtgggaactaaggtccatctcctgaaaaaggaattactacatatacagtttagaatattttgcacagatttgtctattgccccatttatatttacctaatatcaaaatggacacatttgtatttatttcatattttgggttacaattcaatattctgttttttttgttgttgatgctcacattttctttgctttgaccgttggaagttcctctaattcagcttctctgtctctttgacatgccctcatcctgttgttttcttgaacatttccttttgttatggtactaaaagctgctccaggttcattttgtatcagctctagaacagactatttctcaaaggagtccttagtccttctcctggctcatcatattttaaaatcaaaatctgggcactgggtgtgcttcttgttactggggtgtcattgcttcgaggctctttcagctgccagaactttaggtaaagtatgttctaatttatgtatattaacatatctataattgtttctgtcactatcttgttaaagatattatgtcatgtatctctctatatatgttaaatatacataagttcagctgggaacggtggctcatgcctgtaatctcagcactttgggaggccaaggcgggtggatcacaaggtcagaagttcaagaccaacctggccgtgatggtgaaacccggtctccactaaaaatacaaaaaattaattagccgggcattgtggcaggcacctataattccagctactcgggaggctgaggcagggaattgcttgaacccgggaggcggaggttacagtgagctgagatcgcaccactgcactcgagcctgggagacagagtgagactccatctcaaataaataaataaataaacaaacacaagttcacactgatgtctccaactctagtctagtaccatagggttcattcttgccattttgattatctgtggctttcttctctgactgtgagaatcttggctgccatcatccagggagaaaccatttaccacctagaatacagtgtctatacacggttacttttgttattacccttaaaattttcagtcaaaatactgttatctacagctactaaagccagatccattttacccatttttggtgcacttatgccatacatttgtaacacagtcagattcattttttacagtctacaatccattgctggatccctaaaatactggttgattttttagatgtttgtctgtgtccattaaaagcacttatagtaatgtaaagttctattgattttattaattaaaaaatggttatttagtctgggcaacatggcaaaaccccatctctaaaaaaaatactaaaagtagctgggcttggtggtgcatgcctgcggtcccagctacttgggaggctgaggtgggaggatcgcttgagcccaggaggcagaggttgcagtgagctgagattgtgctgctgcactccaggctgggggacagaaccatatcttgtctcaaaaagaaaaaaaaatggttattgactactcactacttcctgattacctttactgtaagaagaatttttcaaaattccaactcatttacatgtttatgagttttaaagatgataatgaaaccaaatattttgtatatgtgtgtctgtttactattatgtatcatatgtagtacttacccaatactatttcttcactataatttttagttataattatataagtaagatgtttgtatgtatgtttttaacaaaagaaacatgttttaacatatacatacgtcttttaatgcatcctttcaaaactgtgatttatcaagtaaaatattttttaaaattctaaattttactcattcagtatgtccatataatgaattaaaaataaaattaaaaatgaaaaccagttttctgaattaggcattctccttatagtggcactatatatagtgataaactttgaaaatactccattatttattagctatgtaactttgggcaagtcatagtattaatctctctggccttagttttcttaatcaaaactcagagtcatactattaacagtacaaaaatcaaaggaagagtaaaagaaccaattaagataacatttttaaagcatcagaggctacttcatgtgacacaatactatatagatatagataccaatatagatagatattgtgtgttgttcatagatttttagtacatttttaagtgcaaatataatttattgtgttgcattcatctacattatatatatgtgtgaaatttgtgaattgctgtctgtaaatatctataaacaacacattcagccatttgcctagaggtttactgctatgaaaaagaaataattagaatttttcaagtacaagtgggatggactgtaaattgaacataattattggaaatcgctttatgtcaattcagaagcttatacttaataattcagggttattttataattgaatgtttatgtcaagatcaacattagtgagggatgttggaaaagattagaaataatgtacaagaaactttgcatattactgctagttctgctacttggcacagtattttgtaattatgtcataactaaaaatcatagattataccacaagagttttcattgtccttattatttatcatttttgagtgtccaccagatttgcgttactttttaaatcatttaaatgctttaaactctcttgccaagaaaatcaaacaaacatgtatcccaatctgcaaataggaagccaggaagctaaatcaaattagcacacaatgtacatgtgtatgcatatatatatactcatatatattcatatatatgtatatacacacttacatgaacacacatacttacatgtatgtctgtgtgtatatatgcatacacacatgaatacatatatctatttgggtaagtgattagactgacagtacagttgaacatgtataaaactggaaatgatacttctgcaactatctactaacatacattatttgaagagaattaaaatcccaaatgaagttatagcctattgcaacctgtaaaacatttcttgtaaattacctaatttattttttcatttatgtacagtttcttatgtaaatttgaaaaatatttgccatggtgcattctgtaaccattcccatattcttttccttaatgcttatttgcatgagaggaacttgggtttttcttgtttgtattggatagctgttaagctaacttcagtatctctgcctttttttgcatagtttaactctttctaatttttttcatattccaaatagatgttagagtcatactttttattttctactttctaaataaattctctaagttgtttttaaaataagaaattagcaaatcagcaaaatatattcctatgattaaagcatggctctgttgagagtcaaaaatggaaagtatctagatattgatgacacaaaagctcatcaatcaacatagcttgctcttagtggaagggatgaagtccataagcaagaaggtagttagtcaacatcttcaacatagataaaacaacatttgtcttgctatataattgtgggatggactttaaggtatagtgtcataaaggactgtggtgcaaagatgtctggggccaaatcgtggctctgccattcactggttgtgttgcctcagacaaggtttctagtctctatgtacctcacttttctcatgagaacaataatagtagatgtggttattgtgatgtttaaattagttaatatataaaaggatgaaatagtgcccgataagcacactaccaatgatgactattattactttttattatgatcattattattttgttgacatagcaaatatattctgtctaagtacattgttcatcttatttaatcttaaataaaaggtcactcttaatgtcatttatcaaaagaacatcaccacacatcagatagtgtaaggaactgtatgaaaaattatatctttaactttaatgaatatttctgttgcttgaaaacatccataagcattgcttttactgtctttcattttagctacttttgcctgcggattgaagtagtagatgtttgagtttggcagaagatatttctgtaataccagtaatttccctgtatagccagctttcttagtgtaggatttctagctgtcttagtgtaggattaattttcaagaacaattattcactgcaggtcactggcattatgacacaaagttgcaagggcagagttgttttcttttctttctttttttcttttttttttttttcgaaggtggagccttgttctgtcacccaggctggagtacagtggcgccatctcagctcactgcaacctccgcctcctgggttccagcgattctcctgcttcaccctctcaagtagctgggactacaggcacgtgccaccacacctggctaattttttgtatttttagtagagacggggtttcaccgtgttagccaggatggtctccacctcctgacctcatgatccgccctcctcggcctcccaaagtgctgggattacaggcatgagccaccacgcccagccccagagttgttttcttatgtgaatttggttcctggcatttgaagaatataagtaatggaggaggtgcaaagttaaaaatatgtggatccagaaaccagtctgtggaaaatattattccatttatcagagttgtaaaattgcaagcagagaaatatatttccatggacaaatagtcaaaatggaaacatccacctcttaagaatctacttgacaagacaacataaacatcttcaaagtatatacaagctgaattattcctatagtaaatcaacaaaaattattcaacatttagacgtagatgtgacatataatttcccattatatcaatttcaaatcaatttaatgaggattaatagcttcttaggttgttcgaaaatatgattgacaaaagataatgtcatattaggtgaagattaacatttcttgttgatgtgtcatgaagtactgataaggatgatgatatagtttggctgcgtccctactcaaatcttaccttgagttgtaataatccccatgagtgaagggtggaggcaggtgaagatcattgaatcataggggtggtttcccctatactgttctcatggtagtgaataagtctcatgagatctgatggttttataaatgggagttcccctacacaagctctcttgcctgttgccctgtaagacatgcctttgcttctgtttgccttccgtcatgattgttaggcctccacagccatgtggaactgtggctccattaaacctctttcctttataaattacccagtcttgggtatatctttattagcagagtgagaacaggctaatacagaggagaaacacataaaactcattatatgccactccacatagatatggagaataaattggtgaacaaatgttatcaactcaaagaatttctaaacttagtcaaaactcaagaaaagttgtcatgaactttcttttatatttttacatataaaataaaattaataggctattttccaaattaatgaacagtactagaaatgcatgtaagcagaacaatttttttccaaaatgaaattaatagcaaaaattgtattaaccatgtgaggaagaatgatgaattagagattcatttcctctagaaaaaaaattgtacaaaattactattatagataataagatagcatgttgccaaaaattaattagagaaattgttacaggtttgtagtagctagataattaataaaaagtattgtgttattttctgatttttgatatttgtgtatttttaaatatttgtcatcgtgatttttttttctcattctaaatacatattttggctgagtatggtggctgatgcctgtgatctcagcagtttgggaagcagaggacggagaattgcttgaggccagaagttggagaccagcactggcaacatagccagatctcatctctacaaaaaaaaaatttttttaaatagccaggcagggtacgaaatgcttacagtcccggctactcagtaggctgaagtgagaggattgcttgagcccaggagattgaggctgcagtcaaccatgattgtgccactgtactccagcctgggcgacagagcgagaccatctctaaaaaataataataacaattataaaattatatataagtaaatactcatatttgctttcataccagctttgtaattacaattttgcattatttttcttgaggaataaaaacatgatccagccccccaaattgcaaaatgtcaggccttacaaaatcttagtgttttggggttcaaatggctgtatttttataaagctgtagaagtgattttgaaacacaacaggggttagaaagcattggtataagaatcataaagacttatgtcaggactttgggtttcttgttgtcaaagagggtaaataatggtttcattaatcaaggtataaaatacagaaagaagcacaagctttagaaaagggtttagttttgaatatgcttatttctaaacaaagtttgctatcgcactaactttgaagaccatatcaaattgcttttatgtttagcttactgtagactaaatccttgaactctttcttttaatgttctgcttcttagtcaattttcttcccacatgtatttgtacattggaagctttggagttcaatccatacaggagtttacttttatctttgttaaatttcatcctgctaggttttattgcatttctctaacctgcacattgctttgttctgaactctttccccggctttctctatatgctggctattttgtacattgattttatggcatatgcacattcttatttattttttctcaattgttcttacagccggggtgcatttataataactgcaaagcattttccctaacatacctgcccatagaatgaattgtacaatcttctacccaattcatatgttgaagccttaactaacttccaatgtgatggtgtttggagatgaggtttttggaaggtaactaggcttaaatgaggtcatgaagttggataatgagattagtatttaagaagggacctgtgagcttgcactttctctccttccagaagcacaaaaataacttgaggtcctgtgagcatagagggagttggcagccagctgcctacaagccaagagaagcagcttcagaatgaaagctgccttgtcagcaccttggtcttgaaactgtaagaaatcaatttctgtcgtttaagccccccagtctttggaattttgttatggcagcccaaactgactaagacagtatctactagaaggttcaagtctgaagaggaaaaaagtttgctttctgctccgaaggcttgtatggaattagattcgtgtgttagagacacacacgtaaagacaaatgcacaggcaggtgagtgctgcttacacaacttatgactattttattatgaatgctttttgcttcccctttaaagttatctagagaggaatgtgctacagctcagagatttgaaagatgacaataattttatgacttaacaggaacctcgtgttacatggaaagcacaatcattttaatttgaaatatttgaacatatatttttataagctaaataacattgccagtcaccaggacctgaattagctaaagatgcatagtttcttggggataattgctactcagcaatattttaaatagtgcttaaaacttcctatgttactaataaaagtcagtcaggctgagttaaaagcctggctaagccacttattacccaagtgactaaggtattttcagtaaatattttttctagtcatttaatcttttactgctttagtctcctcacctataaatgaggatgatggtaatacctattttttttatagttgatgtgaggattaaatgggtgggacgtgtaaaacacaaagaatggagtaggcactcaatattagttacatttctgtttttcactcattaagcaaggtattgtaacattcaatgtaggcatcagagactttgccaaatctcctcaccattttaaatgtttaataactctcccctctttctaatactgagattgcttttagaataacatttttccttcccttcctactcagaatgcacattactgaaataccttagctccaggaagttgagaattagaatatcttaatctaaaatcaggctcttctaatttccagctaaatttcagagaatggaatggtattcatggcatcacttaaaggagttattatttttcaagttttgattctggtctatacgagacaaacttttatgttctgtataagtaattgcacagaaaaatgttgcatcactattttttattgactactacagagtaaaactttgtgtcacccccaaatttatatgtgaaatcctaaccctcaaggtaattatatggtattaggaaacaagaccgttgggagacaattaggtcatgagggtggaacctcttacaaaagagatcccagagagctctctcaccttctgccatggcccacattctgaggatgcagttaggagtcaacagtctgcaacacagaagagggctctcactagaactcaaccatgctggcaccctgatcctggacttccaggcttgggaactgtgaagaatacagttttgttgtttaatccacctagtctagaacattctgctgtagcagccaaaatggactaagacagaaattggtaccataaatggaatgctcttgtaacacttaaatatgtgaaaatggctttggaactgtgtaaagggtagagactaaaagagttctaaggtgtggagtggttgattttagatatcagcttgattgggttaagggatacccagatagctagcattatttctggggatgtcttcaagggggtttccagaaaagtttgacatttgaatcagtgaattgattaaagaagatccaactccatccaatgtggccagatgtcatccaattgattgtggatctggatagaaccaaaaagcataggaaagccaaatttcttccctattttgaagctgggacatgcatcttctctttctttgacatcagaactccaggttctccagcttttgaactgcagaattttcactggcattcccctaactcccccaaccccgccttaggtgtttggcttcagactgaaagttacaccattggcttctctagctctcaggccttaggacttgaactaagctatgccaccagcttctgtgtttctccaggttgcaggtggcatattatgggacttttcaatctccataatcatgtgagccaattcccataataaataacttcttatctacttcttatcatcatcatctataacctattaattctgttcctctggagaaccatgactaataaaaggtgcatgcttaaacaatcctatattgctacgaatggaccattatagctgattttggtaagaacccagaaagaaaggagaagacttttaaagaaaccctcaatctctttatagaattcctaagtagcgattattagaatgttggtagaaatatgggcagtaaatctatgaactacccaacctcaggtagtttgggaggctgaggtgggcagcactttgggaggctgaggtgggcagttggatcacctgaggtcaggtagtcgagaccagccttgccaaaatggcaaaacactgtctctactaaaaatagaaaaaaaaaaaaattagcctggtgtggtggcagagcccagctgagattgcagtgagccgagattgtgccactgcactccagcctgggcgacagaagaagactgtgtctcaaaaaaaaaaaaaaaaaaaaaaaaagaattgaaagatttggaaaattcttagcctattcatattttaaaaatgaaaatacttagggtgtgtcctggtgtccatttgatacagagattagtataggctcagccacagatttaatcagcaaccccagcaggaaaagtgtcagtttgaacgcagaggaaggagttgagaaggaatgaatgaagtctgttagatttcatggattttatagaataagatatggagctatttgactgtgaatatgtgctatttttcattacaggggaagaataaccccaaagttgattcagagattatcagggatacttcctcagtttcagaagggggaccattgcattgcattcaacaagccagatggtcttgacccaaagctatgggatgggaccttccccagtggacctgaaaggcagagcctcaaaccaaaaagtgttactcatggagaatgcttttcaatttgaacttatttgaaatattttatccctttcttctttcctgtttctcccttttgcaatagaagtatctatcttattcctaacccattattgtattttggaaggatataacttgtttggttccacaggatctcagttggagagcaattttcctcaggttgaaatgtatttagtctcaaatatcacctgatttagaggatattcagagattttgatatttagactctagagttgctgctggaaacagtttatacttttgaggctgcttggatgtaaagaatgcattttgtatgtgagaagaacataaattttgaggggtcaggatggaatgctatagactcaatatttgtgtcccccacaatttgtatgtttaaatcccaacacccaatttgatggtattaggagataggacatttggaaggtgaatatgtgtcatatgaatacaaatcctatgacacatattcacctctcatatatggaattagtgctcttacaaaaacaaaaaacacctcacagttatttaaagctccctccccctttcccccttgccaggactcagcatagagttaagagtctggaacttggaggagagccatgctggcagcttgattttggacttccaggcttgagaattgtgaaaaataaatgtttgttgcttaagccacacaatggatgagatccttttgtagcagtctgaatggactaaagtttgaaatctaactgccatattctctgggccccatgagagaagggagcacactttctcagtttaggatggatattatcttgaaatctccccacttttctttttctcagaagacactcccaacttcttctgcatctggatttcctgagtcagaaggtatcttccagggatctgaagtgtagaaagatggaaatcacaagactatggagacttgcaaacattcaccagcagtaccttcagagcaatcaacacagcagaaggtaagtacggtgtcatgctgtacgaaggcatttgccagcattgctggtgaccacgagccatgaccattgctttaaataataaaaatgagagatagatagtgagaacagtaacagcaccatgacaagtaattgaaagactagagtctttacaataaaacctatatctagataaaatgataataacgaggactcactaaagcttaatagattttcagggaattttatgcaaaaaatactacaagttaaaatctggcctgcaaacattgcaacttttctaatcctaaagcaactccaggtaccctcaaactgcaccaacaaaaagtaggcatagaaagctgtgtatgcctcaagaaatattttttctcagatgaggacttgaagggtatggctaaggcatagataggtcacagaagatatcaaaaactgaattatttccagagagcagaaccagacatggccataattactaactgaagaatttatttccataaaggaaaaattcctatactctacaaaagaagtggaaaaataataattctgtaggcaaaagacttctctgtgtttttcactttttccaattctgaatgggccacaggttcatattccagcactgtgtgttgagtatgttgtgtgctggtaacttttatatgtttctggagcttgaaaagctgtgtatcacccagttttcctgggctattccttaaaagcagcaaccagatgtgactgtcagtcatctctcttggggagaggtgagactcttctataggtgtaaaaacaacaataaaaacaaatttggatttgggtgaataaaaggaatggattgccattttcctttttattgcctttgcttacttctggtctactctcaacacaatagccagagtttttctgttaacaagtgagtcatataatgccactccttttcctaagtcctccagtagcttccaatctcactcagagtaaaagcctagtctcccatgaggccattcattgtcttgcctcctagattattttcttcttgctattactgaacttgctagaccttctccagcctcagaccatttgcacttgcaattatgttttctcttatcctccaagaaaatctgaatagtttcttcttcatttccttcagattttacacatatgacactttcaaaatgagacctaacctgacgaccctattactgtctattggaactctctgtgaacttatggagcagtgacaatcatgacaactaggaacacattttactgatatatgttgcatattgttggtcttactccattagaaatgtaagcgttaggattgtggggatttttgtttgattttgtttttcctttttctgtattttactgctaactattgactcctaaaatttgtgcctgtcatattggatcacttcataaatatgaagtggatgttgactaaaatgatagtgcccccaagttgagaaagggtatgaactgttgatataggaacaagagcttcctagcatcctcaaaagttgtgtgttgaaaggctgcattgcactctctaaaagcatttcctgaaagatagcttgaaaggctgcattgcaccctctaaaagcatttcctgaaagatagctggcaaagatcctttaccttttttcttccttccttttgcgtcatactcagtagaatgttatgcaatgtctggagacctacccacagctttggctttcagaataagatgcttattctacaggtgacagaaagatatggtgcaaggagtttgcttgcaagatctcacagaacacagtcactgtgttagttgtgatagttaattttatctgtcaacttcattgggccataggcctttcagactgtttgatcaaacattatgcagggtgtttttgtgagggtgttttggggcgagtttagcatttgaatcagtagaatgaataaatcagattgtcctccctaatgtgggtaggcctcattcaatcaattgaaggcttgaatagagccaaaaggcttatccttccccaagaaaaagagaatttttcatattagactttgttgaaaccaatattttgggtatttaactgccttgaggcacaaactgaaactttctgtctcaagcctgccagcttttggataggaaccatatcactggctctttggagcctccagcttcctgaatcagctgtagattctgtaatgtgcctggccacagaagcatgcgagccaattccttgcaattcatctttacgtatatacacatatatccacatatgtgatagttaattttaggtgtcaccttgactggattacggaatacacaggtagctgctaaagcattattcctaggtgtgtctttgtgagtgtttccagagaagactggcatgtgagttaatagaatgagtggggaagatctgccctcaacatgggcaggtaacatccatttagctggcgcccccaatagaacaaaaaggcagagaaaagacaaattcattctctctcctggagctagagcactcttctcccacccttagacatcagaacttcagtttctacagcccttggaattcaggacttggcctcagtaacctacaggtccccatgcctttagcctggactgagagtttgaccatcggcttctctgattccctgatgctttcagacttgaactgatccatattccttacatccttgataggcttacagatggcctattatgggactcctcaacctccataatttttctagtaaatgccttctcatctatctattcatccatcatccatctatctattgatctagccatccatccatccattacctatctatccatccatctatccatccatccatcatctatctatccctctaaccatccatccattacctattaatctatccatccatcatctatctatccatccgtccttccaccatccatctatccatctatccatttcctatctatcaatctatccctcatctatctgtccatctatccctcatctgtctatccattatctatctatctatcatctatctatctatctatctatttatctatctatctatctatctatcatcttttactggttctgtctctctggagaactctggttaatacaccagtcctaactggctgtgaaggatatttgtgcattttttttccattatggctgaaactaatcctattgaatacaaagaaatcaattttctttcactacaaacttaggaataaaaatttctttattcatacttgtaatataaataagaaagtcaaaaacactgaacagctcagcataccaaatatccattaaatatggtatttgtcctcctaaattgattcttcagttttcttaatagggatcatgtattaatatagtatctgaggatcattattttaatttgggtttgacctaagaggctggcctgcttatgagtttttttcaaccagtggatatttctgagatgtagctgctttctatagaaagattcatatgtttttggagcactggattcccaaaaagaccattggctatttttcctaaacttttgtatttcttgtattttagttattttgtattggccaagcatccttttaattgttttgcaatcattttgtgtgttttacaattatattcagtaaaagtgatactgagagaaatccttaatgaaccaaatgttgaaaaataaaggttggtttcactaatactttttgttgtaaattaatatttaaaacaaaattcatcttgaatttctacctccgctttaagtataagaactttttattatttttatagcaggggtcatctaactcttttttaagaggcaaatagtaaataatttagaatttgtggtccacacagcctctgtcacaactctacactcgactttgttgttgtagacaatatgtgagtgggtatgagtgtgttctaataagactttacaaaaacaagtgggaggaatttggcacttgaaatgtaatttgtcaacccctgttttaaaggacaaaagggagtcttattttctttatttctttattcttttttttttaatttattgagacagagtctcactctgtcgcccaggctggagtgcagtggtacgatcttagctcactgcaacctcagcctcctgggttcaagtgattctcctgcctcagcctcctgtgtagctgggattacaggcacccgccaccacgccgagctaatttttgtatctttactagagacagggtctcgccatgttggccaggctggtcttgaacccctgacctcaggtgatccgtccgccttggcctcccaaagtgctgggattactggcgcaagccactgcaccaggcctggaagtcttattttcttactggataacaggaatatcactgaagagaactaatgtacctggaccttcctaagatgagccactcaagacatccacccctgatagcaacttagaaacagtctacctagacatccctggggcaaatcaccctaaataacaggaacacacttaaccaccttcaggcctttttcagcttacaccaacacatctaactgagaaataaaaataaaatactaagttccccagctgactgaatgaaccctctcatggccaaggagactccagagaaaccttgaaaactgagttccccgccatgatcaatgggagttgagacattccacattatacctcctccctcattaaccaccattagactttttttttctcagagttgtacagaaatcagccctttcaaaacacttgctccactgctgatttcagccagctgaagaagctgtaaccaaaaccccgtctctttttgtggtttcaacacaagaactgaccagcgttcctttctgataagagacgaccaccacaaactggctttggctggtccatgagggctggacacatagtgcctctgtgtcttctgtttcatcttttgatgtataggcctaattttagtgtatttaaatgttgtctccaacacaaagtgaatatgggaagtttgtaacatgcatgtttgcttattacgcacgcaagtgccttctgcattcatattcatagctcttcctataacctattgagtatgtatgctcagtcaactcattcagaataaattcctgtctcaccttccttcttcaaagtgcctgctttgggtttctgtcagatgctgtgcttcacagttgcaggttgtgaccctttataagaaataatgctttcctctccaaatttatgaactccgtgattcttcattgagcataactatttaagagaaatcttagaagtatggtatctttgggaacccatgcaatcagagtatttctttcaaatgtagtcagttcactattcctcactgatatataacactcagaatgtggagaatctgaaggacaggggacgtactttatctgattcattaaagtaacatttctgagaatgacacaaacgtgaaacttatgttgcatgctgagagttgcatcaatagcagcttccaacataacatgtgcaagaaatttttctcctcaaaggcttgagtgccataatagagagatggaaagatagatgtataaatagatgtagatatgtgtatatacatacacatacatacatatatatgcacatatattttgcatatattatcacaatatggtaaagactgttttatgctgtgatgcactgtgagcttcatgcaacttgacatgcttgttatcaatgtttattccttctgagtccattattttcatacatttttagggctacattgtgtatgcaacataaaaacacatttttctatttcatatcccccccaaaggttcaaagagaaactgggaacaaattataaatctgtgaatattgatataaatactgtataaatatgtatatataaatataaatattttacttcacaattccgtatttaaacagttatcatccttcagttttttctgaagttgagaaaattctttttttaatgtttctaaattaattttgaatggatgcaaaatattgacataaaatgtaggacctgctaattttctcttgaattctaaacctgaattttgatagaaaacaaattttttgtcaaaattttctactctttttttacttttttgttattttttatatatccaatcaatatttattgaacctaaactcttaattcttatttaattttaattctggctttatctgtgttgaattattattttccaaatacttctgactagctatgctgctcacatttacctaacatacagtaatacggttgagtttgtttacataccttaccacaggctttaactgattttctgttaatatttttgtccctatccttaagctttcacaaaataactgtatgaaacaaggtaaaaactcaaaatagtttaatcacctgaaaggtggagaatagaaatccttaagaaaagtgttgggaccaggaatcacactcaacacctacttctctttcattgacaagggccaatctttcagagttatgtttattttagctcttgaagatctctcgaaattcctatatgtctctttctccattggtctcaccctaatataatccagcatccttatttgactcccaaatccctctgtttccaacacaggagccccagtgatgtctgtaaatacacacctaatcagataccctgctgcttacagtatttcaatatctgctgcttgcggtatttcaatatcttcctttggcttttgcaataaagaccaaagtccttaacctggactaaaaggatctggataggctagcccctgtctaccttgatagccacttcctgtatttttatatcactatatactgctacttcatacattgttaagtttttgttgatttgtgtgatttaattaatatctatttgttccattagaaagcaacttccatctatgtaagtaaatattaactgcttatcattgaatctccagggtctaatatgatgttcagatgatagtagcttattaataaatatgtattgaataaaagagaatatggaataattatattcaaccctctatgaattctttggtttgcattcaacaaatacttattaagtcctgaaaatgtgtcaggcattcttcttggcttttgagattcatcagtgaatgaaagaaacaaagcttccctactctaatgctgtcttaagttagtgtgggtaatagatattaaataataaatataataaatgaatgaattgttttacaacttgtgaaaagttagagcagcatacataaaattgggggaaattggggaggggaaagctgcagtattaaatagacttgcagccaggcacagtggctcacgcctgtaatcccaacactttgggaagccgaggcgggcggatcacgaggtcaggagatcgagaccatcctggctaacacgatgaaaccccgtctctactaaaaatacaaaaaaattagccaggtgtggtggcgggcacctgtagtcccagctactcaggaggctgaggcaggagaatggcgggaacccaggaggcggagcttgcagtgagccgagatggcgccactgcactccagcctgggcaacagagtgagactccgtctcaaaaaaataaaataaaataaaatgaataaataaataaatagacttgctagggtagactttactgaggtgagaattgagcaaggtaagataatggtgaagatgggttttgaaggtgagggatttagatatgtggatatctggtggaaagcatttaagacaaagaataattggagcaaatcgctgcagtgagagcactcctgatgtctttggcacgtgatcagcacgacaagagtcataggaagtccaaaaagtagcagggatgggtgatgggcttgatgacagaccatgaaggactttgttgtttactctaaagacttctgcttttattgtgagtgtgataggtaaccgctggaaagttttcagtgaggaataacatgtcttatttatggtttatgggtcatgttggctactattttgagaaaaaacaaagggtgaaaggtagtcattaaaaaaaaaatcagtgaggatgctatttcaataatccacgacaatggtagtttgaatgcaggtattagaaaaaaaatgctaataggctgagtttctccacatattgtgattatagagccaagtggatttcctgatgaattggatacagaaaataagagaaagaacagaattaaaaactactacaaacattggacctaacaaataggagggttagagaggccataactataatgaaaatagccacacatgatgcaggtttaagcaggaaggggaaaatcaacagttcacctttgaaaattttaagcttgagatgtctactggacatccaagtagagatgactataagtggagctgtaaaactcagaattagaaagagtaatctggtttggaagaaccagtttgagaatcattgacttaaagccacaattgaaggccgcgaaagtaaatgacattagcaaaaggtgagtgtatagaacaaaaagagctagctgggcgcagtggctcacgcctgtaatcccagcactttgggaggccgaggtgggcggatcacaaggtcaggagatcgagaccatcctgggtaacacggtgaaaccccgtctctactaaaaatacaaaaaattagccgggcgtggtggtgggtgcctgtagtcccagctactcgggaggctgaggcgggagaatggcgtgaacctgggaggcagagcttgcagtgagccgagatctcaccactgcactccatccagcctgggcgacagagcaagactccgtctcacaaaaaaaaaaaaaaaaaaaaagagctgagcaccaaggactgagccctaggatagtacaagcgaaggagcaaaaaggaagataaagaacatgcaaagaaaacaggaacagagtgactagttacgtagcaggaaaatcaaaactgtgagtgtactgacagccaagttgagacagtaaaaagcataatataataaagtcatgatcaatttggacacatactgaggttgggctaagatggagattaaaatatgtatttcagtgttgcttttgggagtctgtatcttttaaagtaaatataagaatccatagaattaacttcattaaagttgttctgatttgctttacatatgtaggtttgatgatgggaagtagggattgtagttctttatataatctaatgtattaaaatcatagttttgatgttttcaaaatttaacttatttggctttattttatatgcatataaatttttcatagcaatgaatatgactaaagataaattaaaatttgtacttcagttctgtgaaatacttgatcgaatgtttagaaatacttagatgatataattcaacttttagtagtagcaagaagtaatgcattctgaaaagtgaactttgaataactgtcactgtcataattttatttaagaggacaagctctataaaaggttattgaagctaatttgaatgataaatagaattctactaaaatagcagtttactattagctattccagaggagtttggggaattttaggctctatgggacagattttctgtccagagtttcttcctagcatctctaatacgagttgcaccttattaacccagggtttgcgttgtgctctgttaattctatttcttttctttttttttttttttttgagaccgagtcttgctctgttgcccaggctggagtgcagtggcacgatctcagctcactgcaagctctgcctccagggttcacgccattctcctggctcagcctccccagtagctgggaccacaggtgcccaccaccatgaccggctaatttttgtgtgttttttaggagagagggggtttcaccgtgttagccaggctggtctcgatctcatgaacttgtgatccgcccacctcggcctcccaaagtgctgggattataggcatgagccaatgtaccctataatttagtgtaacatcttagtcaatttttttcaaagttaaccttttatcctccatgtttacagagtattacatagagccatttaagtttacattgcttccaatcatttctgtagctaaacagaatgcacatgttttcaaagtgaaattatgaccccaaaaaaacagtttaatgattgtgtgcagacattttgaaatctaggcatatgattgacttttagtgtattaaaatcagaagcccagaaaatgaatgctgagatgcattatatagagggtaggaaataagataatcagcaaatatgtagcctgcattcctcaaaggaatataaagcattagaatgtaggtaagatttcagtttttgctttaaaattttttattttctatgtgatttttgatactgttagccaaagatgctgtggctaatagtgctattttctgaaaggatatgtatgtatctgaaagtactattacatcaatctgtggtgttttgtctcagtcgttcctggggtggattccattatctgcagctctattgcgttatggataacactttgcttctctttggacagagtatgcttctaattgtttgcacactgtggtgctttgtagctttcttctgcctgttactacatttcattgccctcaaaggggggcttctgagctcttgaaagatttcttaaacccacattctgttctgctcgcccttatgcagctttttggaagcatttacctcgacaacccagtgttctgttctgttgactgtgaacatgtggctttttgtcgcaaagctaatttgcagtgatcatttttgaagctttaggttgaatgcattgctttaaaataagaattatgtcacaaacaaaagttgagttgaaagtgtttccactgatgagttttgtgtaatataaaatatatatgaaggaaaataataacagttgattcttatttacatcccacaaattaaaatatggggctgaaaagttatttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagccaccgcgcccggccaaaagttatttttaaagttactttcttagagggtcatgtatactatgcaattaaaattagacttgctaccgtatatatttttactgacagaaaacaatagtacacaaatccagtcaataatttttgaggctcaagatggctgattagatgtagctacagtgctcctcttccatggagaggaaccaaaatatccagtaaatcttcacactctaaacatatattttgtgagaaaacactgaaattcattagagaggcaatgggaaatactgtggttgaagagggagtaagctgggctgcctgctcagttacgggtagcctacaagcccaaatctcaccattatgcaatatatgttacatagacatgtaacaaacctgcacaggtaccccctgtagctatacaaagaaagaaaagaaaaaaacaattcaaagaaaggcatatcaaatgtttaactgtgtaaggagaagaaaaagacagcttgtgaataaaataattaaaatggaaaataatactgttaaaatactgaaaaaaaatactgtttcaagtatttagtgcgaagaactgaaataaaaaagccacaggtcattcataaagtaccacaaatgatcataatagtatgaagaatttcacttattaagatttgagtagaagactattttaaaatccttaacaattctaaacttgtatttacataggtttcacaaagtagctaaaaaataaaactcactggggaggccagacaaaataaaaaataacaaaagacacagtatgaagaaaggcatcatgggagaccagtaacttaattgccatcctctcctttgccagaggggaaaccttttatttaccacatgaatattaatgtctcagttatctcaatcagtgtttggggcccctgaggaagatgataatttcataatgacttttttttttttttaagagacaaggtctcactctgttgcccaggcttgacagcagtggcgtgattataccccaccacagtctccaattacggggcccaaggatcctcctgcctcagcctgccacatagctgggactacagatacgcgacaccgtgcctggccaattttgtactttttgtgaagacaaggtctctctatgttgcacaagctgattttgaagcaatcctgcctcagcctcccaaagcactgggattacaggcctgagccactgcaattggcccctcaaagaattataactttgagaaattcgatctcagaatttactgcccttccctttcttcctttttgtgtgtgtgtatatgtgtgtgtgtgtgtgtgagagagacagaatctcactctgttgctcaggctggagtacagtggctctatcttggctcactgcaacctctgcctcctggattcaggcaattctcgtgcctcggcctcccaagtagctgggattacaggtgcctgccaccacaaccggctaatttttgtatttttagtagacacagagtttcaccatgttggtcaggctggtctcaaactcaggtgatccatccacctcggcctcccaaagtgctggggttccaagcgtgagcggccgtacccggccacttttcttcattttaaaatatttccctaggaactctatcatcctttaccaataaacactttcttgtttaatgaagcagataattattttgtgttttctctatatttagatacctcataatattactttatgctttaaaaataagctaattaatattatcttttacattcatcactgtcaatacattcatctcatctaatatctataagaaatttatgacgtttttttattatactttaagttttagggtacaaaactaaaaataaaaataaaaataaaagattaaaaaaagaaatttatgatgattgtctttcagtttaatctgagaatggctctacatttggagtcgatattaatgactgcataggttaagcaatgaccacattgcatactctacttgagttactaaacatacagttaatttacatttcttctacctgttttctaaaagcaattgtcactcaccatatattaattataatacagtaattacctgtgtctttatatcaaactcaactttattttcctacaaatgagtaattttactttaattatgttgccatactttttctcattcgtttgtttaatcatgcagatttaagacaccatctaacaacaaatattaattatatttgttcaataactgttgtaatttattcaggtaaggtaagaggtttgtaagattaccacacaagtcaaatttttttcctgcccccttttatttcacacttggacttttccatttgacaagcaagtattaggtttgtacaatgtataggactcgtatagagcattatgagaaacgcaacttaccatgctttgagtattatctagacggccttcccttgttcagacgatgaatttatctctaatttaagtatttatttaatttttcaagttaaaacagctttagtaatacgtgttaaatcagatacttgtgatatgtagcactcagttgttgttttttaactaaaataccatgtgatcagaatccctggatccaaatacatgtcaattgataaaaactatgttttatcttagtctgagctcatttatattggttatatgctctgtctttcatattttgtttatacttaaaatgtaagccctacaaatcctgttgaaaaagggctatctatatattcagaatgaataaagaatatgctattattacttttcatttcttttgggctattgggaaagactgcacagtatttgttaatatcacaggttttggagttagaaaatcttagatttaaatccaatttcaatcatgctatgacctgtctaccttaaatagcattattaacttttctgagccctaatttgcctctatatgtaacacacaggactgaatggtcaaggcaaactcacagaaatcatgtgttttacccaaggcactaaggttcaaaagatacaggcaagacacaggcacagaggaacatgccttcctggggaagactgaatctctgaagctcaaatttctaattgactcctttgtcctgcataccagttttttcctgtctgatatagaggaaggcaccacaggtctgctttcctatcttcttttatgaacctgtatctctgccacttttatagttaggctttctagaacaacgtatgcatgtgctgccacaaagttgcactttaatttcactgttcagttccctaccatataattttttacccatctatcaccctcagattgtttttgctgtgttcaccattgagctccagcttcacaaacacagtatcatttagaactcgcttcccccacaccccccaagaactttctgaatcattaaagatgctgactcctgcctctgccatacattcatattttcttcatttcaatgacattgcactttccttatattctttccatacttttgcttttttccttttctgtctcatttcactccttcctggtaaattgatgtctaatttttaatgtatattaagtttcaaccaggttttttcttaacttcccattctacattctctgtgtaaatattctttcctacagctttaaataccatgccccaaattctcaaattctatttgactacaacctctcctatgaatttcaagcttataggtcaaaatatgctcaaaactgaaattcaggataattgcatggatcagagcagtgaggctcattcttgatatttaattctttagttaagcctatacacaatcaatcagccatgtgtccattctacctccaaatctgcttatttccatctgacccaactacccctaacccagcaaattattctttcaccttcaaggattactgtcaaagtcttctcctgcagtaggaagattaaatttaataaattgcaaatcatatctccaacactcctctttacttaaatttatataaaatccaaactccttactttgtcaaaccacgtattaattatttcgttctcactcaactcttcatctttttccacacagtaatgacactctacttgctctgctcttgctgcttttgcttcgtccaaatcaacaagctctttttctgctatctgcctcacagttatctcttatccatctgtcaagcctcaataaaaatttcacttccccagagaaaatgtccctaaatcttcaatcttaattaattattttctgtaatttcattccttgacattataactttccttcacagtgtttatcccattttgagtttatgcatccatttcatttatgtagtgctaatcacctactagatagtaggcttcctaggccttagagggtcagtaatcatgttttttttttttctgtcttcaaattctgctgcatgtataatcctcagtctctgatcttagaaatggataaaataagacttgatttgctgcatagttaaaagtaagtacaatgatttatttgattctttagtgaggctgaaacatcacaagcctttattaaattgtgtttattaattgtgtttattaatgagaaatagacttactttttttaagaatagaggcaattattttatggtttcaagccagtgtgccagctctcaaagcccagctttgctaattttagctgtgcatttgtaggaaaattactttgtatctttttgcctcagttgtctcacttttacaatggggataacaacatctgatgggttataatataaacaaaatgggtctcatgcctgtaatcccagcactttgggaggccgaggaaggtggaccacctggggtcaggagttcgagaccagcctgaccaacatggtgaaaccctgtctctactaaaaaatacaaaaaattagctgggtgtggtggcaggcgcttgtaatcccagctactagggaggttgaggcacgagaatcgcttgaacctcgggaggttgaggcacgagaatcgcttgaggcacgagaatcactgcctgggaggcagaggttgcagtgagcaagactacaccattgcattccagcctgggtgacagagtgagacgccatctcaaaaaaaaaaaaaaaaaaaaggacaaaatgagttaatgtattctaagcacatagtacagtatgcaatacatacacactgagcattcaatgaacattgacttttgctatcattaggaattatttttacctattttaacaaatatctagaggtttttcttctaaagatatcatctgttctatattgtcttctgaaaactttccatttactgttcacatttttactatagtttctcttctttaattctatattaaaaagtttttccagtcatgaaaatgatttagatttcctttttcctctacagccttctcaacttttttgctaacactttttgcagtgagattccaaaaatgaattatgatttcattttattctctttcagaatgtcattgtttggctcagtaaaatgtctctggtccttcttacagcactttgaaatctctatacttaaatcttttactgttccgagaccttattcatgtcagctcattttaaaatctcccttctagtctgaaaatatctcacaaaattataacccaaggttctaaacttgcattaatctgctggctttgaactgtctacatttctagctcaagttcatcccacgcacagtcccgaatgccacaagacgtccatcctgacaggtacctttttttcccctctgccactccttatacttccaggcttcaccctatgctgaaaatggcatcttaatcagcatctactaagtacattctttcaaatcttcttcttacgcccaccttttctgttaagtctagaatactgaaattaacttccttcctcaaattattggcccactgctgtttttgtagctatagttaaccttcaaatccacataataggaatgtattcaaatggaaattagatttttaattgacacaaacatctttaataattatttaaaaaccaaattttgagaatgtgtctgacattttctaagaaacaaaagattatttcaagaataaataattcaatgggtatgaaggagatatctgtattgcatatagtatctgtagactatataaatccacttatttctaaagagcattaagggcagggccttgctttttaagtggttgtaaagatcttatattatctgttttttgtgccatggtgacaaaaaaaaactgaataactctacaaattaagatactattactatgacttactattatagcatcgatcctttgagtgtttacttaaatattgagcattgtgtgcctggcaatttactaatttacaaatgtgcttccattaccagaaaggagtcatcatttagaccccaagagaggtttcttgtatctcacttaagtatttgaggtgaatccatagagtaaagtgagagcacgtttattaagaaagtaaagcaataaagaatggctactccacaggcagagcagagacatgggctgctcgactaacaatatttatagttattttttgactatatgctaaacaaggggtggattattcatgagttttcagggaaaggggtgggcaatttcctggaactgagagtttgtctccattttagaccatatagggtaatttttgaggttgtcatggcatttgtaaactgtcatagcatgggggagagtgtctttcagcatgctaatgcattataattatcatataataagcaacaaagaccaccagaggtcactttcactgccatcttggttttgatgcgttttctctggcttctttgccgcaacttgttttctcagcaaagtcttcgtgacctgtattttgtgccaacctcctatctcatcttgtgacttagaatgaccaacctcctgggaatgaagcccagtaggtctccccttattttacccagcccctacccaagatggggtcactctggtttaaatgcttctgacacttccacttaatttcacaataccaaaactattataaatttattattgctatattataaatttaaaaactacatattagagttgttaattagtgcaatttataaataaatacgtgaaaccgtttatgaaaggattttttttttgccgttaaacttccggtaggcagaataatggtctccagaagaagtccatatttcagtctccaaaacctgtaaatatattgcactatctagcaaagaggaaacatggtaacagacggaattgggtttttaaataatctcatcttaaaataaagacattatcccagattattcaggaatcttcaaatgtggaaaagggaaacaaaaggaactatcagtgtaatttgatgtgagaaaagctctactggcaaccgatggtttttgaaggtaaattgggccaccagccaagaattccagcagcctctgtaaactagaaaagacaagggaatggcttcttccctagggcctccaggagaaaccattctagaggtcaaaaattcttaaatcaagttatcagtccctgagtagcagggggctgataacttcatttaagaatttctgacctctagaactgtgagataataaatttgtagtgtttaaagccaccaattttgtggtaattgtgttacaaagcaatagaaaagtaacaaaggtcttaaattatttgtattttggttatcaaaacattttaaaactgcaagcacttgagaaatgatcagatccagtgggctcattaatcagatgagaaaaataaagaataaagatactaaattaattgccatcaactttttctgaatgctcctattggctttcaattgacatataaacaaaacatcagaagactgcttttgttctttctatacctgccttcgcagactgctagaactattagaatagtctgtttcttctgatctaggatttgttgcactttgatctacagtatctctttgcattcccaaaatacttcagagggacttattaatatattatgaaggcaataaatattgtgagaaaatatttcttcatttaaatgtcctaaatagattaataaattttatgtaatacacaaataaaaacaatattattttagggtttcatttgcttgttcttctacagtcactttcttaatagtctagtgaaaaagattctgttttgctttgtgaggacgttattggcaaaattaaatgttggtaaacatcttttaaaataataaacatagcaatagctatcatttattaagcatttcctgtgtgttgggtactgcttcatgtgttttatgtgtattatctaatcttatttgaaaacatttgcatgaggttgcattattacaatgcttaatttaaagatgaagaaataaaggcacctaatataatggttagataacttgtcaaatgtcacacgcatggaaacagcgttaccagaatttaaacataggctatccctaaccaaagcgtgtgtgcgcacgtgtgtggtgtgtgtgtgtgtgtgtgtgtgtgcacttgctggttggtttggtgcatttgatttgtttttaagtaagaatatggaaatactaatttcaattatcacacaaaacacaaaactgaatctaaatgtgtaaatgggaggcatgatagtaacattgactttattttattgaacgtcaataatttgcatataaaacttttccaagtacactgtattttaatgaattcagagctcagagcatacacaaatagtatttgttggaaaattttaaatgactaatttaaatgttcttatgaataggccattggaaaggcttttaaatataagtaatattgcaatgtatccagcatatggcttgtttctcacatcatgctatgttaaatggtaacagttttctttatatttctttgttttaaaataatgtatgaatttttataaaacattacaaattgtcatatgaatagaaaggattggcaggaaaacaacaatttaacagcaacaactgttgtatattagtcttcaacaaaagggattcctttttcagagaaaattagattttttttttttttttttttgtgagagagtctcagagtgcagtggcgcaatctcagctcactgcaagctccgcctcccgggttcatgccgttctcctgcctcagcctcccgagtagctgggactacaggcgcccgccaccacgccaggctaattgtttgtatttttaatagagacagggtttcaccctgttagccaggatggtctccaccttctgacttcatgatctgcctgcctcggcctcccaaagtgctaggattacaggcgtgagccaccacgccctgccgaaaactagacttttaatcacaagatatcaaagctgctagtgtaccttctcaattaacagtcctcgaagagtgtgatgactggcatcagcaagtggggcagatagtttgctttcctagggggagttcatgtcagtggaaaaggaaggagcagttcacttcttcagtgaatggcaggtagaatagagcctcttatgttcctgagtctcatgacctgatgactcttttcttggaattaatgggttctgatctgagctcttccatgtggtaggtatttatcggcactcagctcaaattcatagaatgaaaatagtaacttctaagccatgtaatagaatactggttttattaaccaaaagtggggtttggtggtgatggggatcttgttttagggcaccaaagtaaagtgatgaaccacttaggaggcactctttcaattgagtagcaatttctgggcattttttctcccctgaaaaaaagctgtgtagcagcttggggtggacaaaggctgtctctcaagaagagagtaggaacatagcagattgtggcaaggctatgccagataaaacatggtaatatggtgctattccttccttcacagtttatccgagatccaaacattttggtggggttgagaatcaaaacattttgttttaattcttagatactggccaaaaatcttattgtaatttggaatttcttttgataaatacataaaattcccaaagtttatatattatgttaaatctcataaaagcatataatctactttttgtacattttatattactttctctctttactttcatgatgatttcaaggtacccacatatacataactttttgcctttgaaacttgcttttaaacatcaaatcatcagctctaatggtggaagcccttacatatatatatgagagcttattattacatatatattacacatatagttcttatacatattaactcttatgtagaaatccctaaagctaaatgatttctagcaaaaattagatgatttaaacccaaaatgcattatttccataaatattgggaaggttctctttcccaatgagtcttgtttctgtttaaataagaatattgcaagaaaccacaactcgagcaggacttttatattgcctgatgccagcactagaccagagggataccagtggtagctgtagagattatttcattatgatgaaggaagtccctcaaaaacaacagtgcattttgatgtgtttactgtaaccctcatttcaatttttccctttttaagttcttttttctttttttaaactctattattaaaatcttagcataatgagcagatagagaattaagtacagagaagaaactgcctcatgaaacatagtcacagacattttctacacttaagtttattttatgtgctctatttgtgattttgccacatttgatgtatatttttcaagctaatcttgattaagtattcatggcactagtttcaagcaggtgtcagaaatcctggtttgaacatttctggtgcacagaggactgtgctgacattttctgttcaccctccatggacagtaattttttttaccataaattatttatgcttcctaaagcacagtttagtcacagagagtcaaaatgacagtccttactgtggttagagcattgtggagaagaaagacataaatctgatcataaataaaaagatataagagaaagtgcaatatacacatatgacctgaaataggttttaatatagaaaaagtgagaaagaagctgaaggtaccactgttcatccctctatactgtagatctcctatgcagcatgccacatgttatctgtgactgacaaaaatgctgaacgctttctctcctcatcacaagaattgtcctgcacaaattctggggttaactattctactgtggacataactaatctactatatgatggaattattttataagaatgtaataaatagtcaaagaaatatgtattaagtagattactaaaaaacacatatatatttaccttgattatctatttaaataacacataataagggagagaaaaataaattagaaaaaatagtaatttgcaaagaaatttgtgtgattatctaaagttatttttagatttaaaaggaaaatattaaatacaattattgaaaaaaatacatagacctagacatagttttgtaatattttgccgtctctgtaaagagctaccacacaggcctatgataatgagaacagttcacttcatgaaggcaaaaaattaaataggcatcattttatttaatctgatcacaggatcaggttcacgtaagattgagagtaaagtgtggaggctttgagagaaaagagttattatcatccaataacctaacataagcacaattaacatacatatgggaaagcaaagaaaagacctgtggaacatgcaagaaattcggcaatatgtcatccacgaatatcttgtggaagtatttaaggaaagcatttagccaaaagtaaaataaaataaaggcagaatgcagatactcaaagtaaaatgaaaaaataaccttgaaatcaaattttgtaaattttcaacaaattcatatgttggagtagtagtataaggaagacaggtagagattggtaaatcagggaacatatgagaatgtaaaatatgaaggaaactactagtaaatagggatttgtagcagtgtatccaataaaagatgtgaaaccataacaggtaaacataaaaaaagtaattaggctcatggactatcagaaaaaataaaaagtgtaaaaataagtaaaaaatgcagtataaaaaagaaatcataaaccaaacacattagttagcatatttaatagaaactggttaaattattttactaaagaagtgctctcacattgagttctagctatattccgttgagaaagaacatatctaaaggaagagcacaatgaagaaaataacagaatatagcatgtcaatcaaagaaaacacttctgaaaattattaacatcagatacatcttaagatcaaaaaagcaaaagggattgtcttatattttcaaagacaaaagaataatatcctcaaataagatataataggaatgactattcacttggcaattcttaaaaatatagtgatagggcaggctgaagaatgtccacatctttaacccacagaacctggaaatatgttgccttacatggctaaagggatttggtaaatgtgatcaaggatattgaagtgaggagattatcatggattatctaggtgtaaccaatgtaatcataagggactttataagaggcaggagaaggagatgtgatgatggaagcagagttgagagaaagaaacagagacagagtaagagagagattttaagataatacaccgttgtctttgaaggtagagagcacaagttaaggaataaagaaagcctttagaagctggaaaaggtagaaaaacagatcctccctgtcttagttcattttcttttgcttataacataatacctgaaactgagtaatttacttaagaatatttatttcttacagttgtggaagctgaggagtccaagtttgaggggcctcatctggtgggagcctgtgctcatagggactctgcagaatcccatggcagtacaggacatcccatggcaaaggagctgagcatgctagcttagctttctcttcctcttcttacaaagccattagcctcattcccatgataacccattaactcattaacacattaatctattaatccatgaatggattaatccattcaagagggcagagcccttatagaccaatcacctcatggaagttccacttcgtaatactgccacattgtagatgaagtttcaatatgagttttgggggaaacaaacatgcaaaccatttcactcccctatagctgacagaaaaggatcagccttgctgacaccttgattttagcctactgaaattgattttgtatgtctgacattcagaatgtaagagaagaaacaaaagtattgtttaagcctttaaatttgtgataacctgtaatagcagcatcagaaaaccaatgcaagtgacaaaacatataattttttttgaaaaacccatatttgtaaaagaagacagtactaaagccatctcagaaatcaatgggttaaatacccaaaagatagaaaggctttaggggaactgaatctttaaagtcaagcttgtcttaattatatataaaaatgcaatatcaggcagtgtttaaacatacacttcatacactacatgaatgtttatggaaataatatatgaataaggccataaatataatctcaattaattaaaaattagaaaaaaatatatatatatgtagtttttaaaaattcttatacaaaaacaataatataaaaatattatttgctgattatagaactctgccccaattcactcaatcgataatctacttttctcattatattgcttttagactggaaaaaattaaggtttccaagaaaaaaatagaagaatattccaacaattctaggcagataaattctttcataaagagagcatggatttaatacagaataaagattaaaaggtttggttctaccgtatttccatataataagagaaccttacacaatggaaaaatggcaaagtatttgcaatttaaataggtaacaagagattaacatctccaagctaagacatgtttctaatagcatgataattttaatcttcccccactccctgggagagtttaaaataatttcatatgaaaatttctcatgaaagagagctgcttatcagtggataatttttttatctcagaagttagttaacacaggagaaaattatatgggagtgttgaagagctgcttctaattgttggacagttattttctaaaggggtgatccaaaaatcctgggcccatttgtcttggatagatcctttctacacttagtttccacatttataattcaagtgtatatcgtttctgttagcattctattaagtagaactcagttatatggccacgagaaactgaaaggtcagccagaaaatgaagttgacatagccaggaagaagaaataagcttgcttgcacctagccatctctgtcacaggggcttctgacaacatttttgaactgtggaattctgaactcttttttctgtggtagcctcctttatattcctgaattttaagcaattgtgttaaggataacacttcctttaatcagaatattttggcaccaagttaagcttttctaaactgttacattactggttacaaatcttgaaaataaaaacaagtgtttttgttttttgttttctgtttttgtggtttttttgtttgtttggttggagttttttttgtttttctcgctacagggtctcactctgttgcccaggctgcaggtcagtggtgcaaacacagctcaatgtagcctttatctcctgggctcaaggaatcctcccacctcagcctcctgactacctgggactacaggcaagtgccaccattcccagctatttttttttttttcaattttgtagagatggggtcttaccatgctgttcaggctggtcttgaattcctaggctcaaggaatcctcctgccttggtcttccaaagtgctgggattacaggcatgagccaccacacctgaatgatttttttttttttttaacagagaaaaaccttaaggtggaaaataaaaacaaaattatctttcctatataacacaataatgaattagaattcagtgttactcaaattattatacggttagatttcttgacattttgtggtgtgcaatgttcaaaagcaaatcttttttttttttaattgcctctgtctgcagtctacacacccacccaccccccgcccccacctcaggctaaagcaaataaagaatctgataactgcattttttaaaaattgctaaattaaaaaaatgaatcccacccctccaggggtataagggtaatgaatgaggaagtactagccactgaacataaagctatcaaagatataatttaaatagtaggccaggcacagtggctcacgcctgtaatctcatcagcactttgggaggtcaaggcgggtggatcacatgaggtcaggaggttgagaccagcctggccaacatggtgaaaccccgcctctactaaaaatacaaaaattacctgggtgtggtggcatgcacctgtagtcccagctactcaggaggctgtggcaggagaattgcttgaacttgggaggcagaggttgccgtgagccgagatcgcacaactgcactccagcctgggagacagagtgacactccatctcaaaaaaaaaaaaaaaatgagtaaataaataataaaaaatattgtatgaaatattgtatgttaaaactaaaacacacacacagaggttaggaaagtttcatcataatattaaaatgatacataccaataatttttaaattatcttggaaaatatcaacttttcaaccattaaatgccttgctgtaagaaagaaaacaaatcacattatattgtaatttatgtagtcaaattatcaagtcactgcttgctccccaaaaattcagatagaaaattataataaaagaaacattaaacagagaaaaggagggagagaaacttctcaaaaaggcaaactaagcctcattcaaagaaaataactttttcttttcaatatcttggacactaatttttaactgcattagattttaatcaatccaaacatattaaatattttctcaggttcaaaatgctgttttcaaatctgaaatcctctacctagaagaaaaaagattacttatatacatgttaaagcaaaaatacagacttaaaggatgacttaactatgcataagaaggtctttctgtgtattttcagttgaactactaaacctgtttcaatgtagatgtacttttttttaaagctattatctgctaagaggaattctgagagaaaattatggactggagattttgaaattatccagaaaatatttatgtgtgtatatctctaaaattatctcagcattaaggtaatttgtgctagtgttatatttctttatctgggtgctggtaacacaggtaatctacatttaaagctacacattatattcatttttctctatgtatattagaatttaataatttttaataactagagacatagaaaggtagcaaagacaacagcagcatattttttccatctccccagaaaaacagacagagcaatggatagcaaaacacatccacaaaccccatttatagccaaactaggtgaaaagtgttaaaagaaaaaccttcaacaaattaaatttaacagagcaaagaacaggcagcctcaaaccagaataaattcagaaagactcttgcacatggtcaaagtagatttatggacagaaaaagaaaagtgaggtacagaaacagctggagtggttacaacttggtgtttgccttgtttgaacatggcttgaacatttggccatctcgatgattgttgagatgggtaggttacagtctgtgtacacacccagttaggttacagttcactatgtacggagagacctttaggctgaacttaaactatgtaaggaggtagctgtaggctaaacttaatttaaaaaaaggtatccccttcaaccccaaacctcaagcaattggtgtcaaacctgtctgtgggaaagaaggagaaagccacaagggaagcttctgacagaacatccacagaccccaatatagccgacatgaatttgttgaaaaccacagatagcctgtctgagaaaagcacctgaaacttgagggcttggatgagcagccagtagcgggtaccagtagtaagaaggccagaggagacagagcatatcagtgccaggtgactctcagaactgaacagagaaggcttccttctagtataagcccctgctctggggagcaacggctgcaagggaaataaagattcaacaagataggggaaacagatgaacaagagggaaggtccagactacactagggaagggaagatagccaggatttcacagaaagcaatctaccacactgttgaattctggatgtaaaatatccaaagcaggagctctgagaagatggaaaagtttagttgaactctgttccattgaaaagctcaggaaatcttatttcacctaaaattgaaaaagagaacagcataaatatcaaatcgcatgcatgccaagttattataataataaagagaataaagaagaatactatctgtacagacaaggagagcttgccagaaagactggtgcacaaaagagatcaaaactataacctactatttcaaaatgaactaaaagacattaataaaataatacaagacatgaaagagcaacataaatcagaaatagaaaactcagaattgagatctcagaactcaagaaataattgaagatactagaaaaatatttaggaaattagtactaacgatttaagaaattagtactgacgacgaaagaatacaataaaataatgcattaacacaaatagttaaaaaagagcattaaaacaaaagaacgcaacaataaaataatgcattaagacaaatagaaagtaaaaagaaatttaaaacaaacagataaatttctaaaaggagacaaaaggatttagaaaaaaaatagtcaagatattgaaaatagataaggaaatttaaacctgtagatcataagagcccctgaaaaagaaaaccaaagcaaggacataaaatatacattctaaaacataactttaaacttttttttaaggaaaaagaaacaaaaagctacatattgagaaataacactgtgtgccttgaaatgttgactttcatcaataccagagcatattctaaaaaaaattatgaaagttagaaaaaagaaagaatcaatatattttggggacacatagaagaaaagagcatctgactcataaaggaaagaaaagattatagtcagactttttgacaacaacactgaggttcattagacctatcagtggaagttatgcatgtccataaattaaatgaaaaatattatttataattttggttcaaagttattatcacacagttgtaaaatttgatatcattatgaaaagttgataattctattagaagattatgtgtgtgactgttatttgatgaaatgagaaataaatttactcctttctatttttatcagacttctcagaagctaaagaatttcaattaggcattattattattcctgaaatgtgtcttcttggtatataaatttgttaaaggaaaaataaatgaatgatcatagcattacaaattggagcaaactttattaatcactgctgctgtattcctttgccttctaatccagcactccctaaaaccacttcaatctccctaagatagtgcatactttgatgttttataaaatacataaaaaaaccagaaagctcaaatgtattaaataatacagtgtatattgtattcaacagaactacaaataataaatctttctcttagatacctcaaagcacttcttaaataattaatttttaagtgttcttggattaacatatgctgtcagtctggttttgatgaaagaaaaagagaagtttacagaactatcataagcctctcacaaacaccaagttacaggctgaagatatgacacaaaactcacatctctccatactaaacacaaatagatacgatttttcttattagtcaactacaaattcatgtcaaactcatatgcaaacaagttaattaagtttaaaggaaatcattaaaatagaaaaattagaaaattaatttctgaatattataaaatttagaatggtattatcagttgctttgtttaatgcaatttaatgtttgagtatatgaactggagataatcctaacggtacatgtcatattggaggagtagaggaaatagtcatcggtgagaaatagttggatccctagcaaatgttctctctggcacttaacaaagtgtttagtttacatgagagaataataatgcccctaatgctattgtgtgatatattccccaccatcactagagtggcaaaaatatactattaatagacctagatatgatcaggaacatagatgacagcagaatattttgtgattatctaaaaattcttccatatctgaacaatactggaaaaagaccgagtttatatatcaaacttcatctggtaatctagtggttttataagaaaatataaatagaaacaatgcaattacacttaccatagcattgtcgaaccagagaatacactcatcaataatagaacatatgattatcttatatctgtaacattttcacaattacaaataatttcaaatatattatttaatcaacccagaaggctaagattgtataattctgaagaacaaaagggtttagattcaataactggaaattagttcttataatgaaatacaataattcacctggatgcaatactccaaacatgtaatttattatatgtatataacaactagcttacagttcactcaaaaaacttttcattaaagaggaagaatagaatagaggaaaaataaacttaaagatagattggacaacataacatagttgtgtgataatgcacagtctagaaatggatatgatatttggcaacttctccaggaaaatgtcaagtccattttaactatcaaaaacagcccctcagatgcatatccacatgtgatacctgtaaggatacatttacaaaactaatttgtcattcattgccacacatttttatctcaacacgtaaataatcatatatgatacttagatcaacactaaaaacaaacccacttaaacaattcacatatagatgaactctcttacatacaactagttttctaatacagttcactttttctccattgacagaataattaaataacaattttcttgtctacattttattcataacacatacatatgaatgaatatacaagttctagcctaaatagaatctacacatgaatcaaataagttccaatatgctggaaaatactgatttttgattgcatgccttaaatatgaacctgtcattgttccccaagaagagttcccatgtacagaatctatctacactgaaataggaactctaaatacctttatggggaaaggcagttaagtgtgcagtctccctgccctagttaggcagcacagaaatgggcctggggcttggagtaattccttgccaagagataaagagatccctccccgcctgtgctaggcttagcaccttgggctggcgtatctttctctgttctgaactcagtgtttgcccttttggcatgctaaatgcatgtgtcatattgcacctggccaaccccactattatatccattagcagcagggaggatatggggtctttgacctgcagtgcaagaggggtatatgcagaccatcttctgtggctatgaaaggagactcaccggccagagaggacctaatgatgtctgagttcatgtcttcttggcaatctagggttgccacctgaaaaccagagttgacatcttgaggctactgctacttgtaatatatattgttgtgctatttcccatcctccatgtggtgaggatcctccactgaatatggcaagagatgccactggctctacaatttgatgtagcaagcaaggtcaccaacaaagttgtcatggcatggtagaggtgcaaggattcgccagtgcaaccattccagagaggcactagttccctgggaggtgggcagggaggacaggctgactgaggtgctggcttccctctggccacatggaaatgtcattcctgtcaacattgatgagttggtgcaatggaaaaggacagagattctagaagtgggtcctggaagggtacaaagactataccttgacttctggctgcttttgtacttctaggctatcttcaaactcccacaatgtcccaagtgtattagtccattttcacactgctgataaagacatatccacgactgggcaatttacaaaaaataaatttgatatggacttacagttccacatggggaagcctcacaatcatggtggaaagcaaggaggagcaaatcacttcttacatggatggcagtaggcaaagaaaaaactgtgcagggaaactccccctaataataccatcaggtctcatgagacccacccaccaccaggagaacaccatgggaaagacctggccctgtgatccagatacctcccaccaggtccctcccacaacacgtgggaattcaagatgagatttgtttgaggacacagccaaaccacatcagcaaggatcagagacaatatcttagggaattgagaggacccttcagggagctccaaccaatccaggtcacttgcagacctcaagtaaagccagttttcactcaaggcaaaatcattgatggtattgctgcaaatgaaactgttaaaatgaggttcttctctgagagtggaatacaaaatctgagagctagatatggcagaagccatggaagtcctatgtgacttgattggtgcacctatttaatgagggagcttgtatatccaaatgcctggggcctaatagcacagtctgggaaaactaactactgaccacctgctgcagtgcattttgcccacattgaacatgacaaggacagagataagcccatgtcacttttgatctggatggcagtgaatagaagagtggtggctccaactgcacaggacttccttaagagtaataccccttaaaaatattcatgaggtcatagctgttttaaagggtgaaagccataaacacctggctatatgaacctgcccctggagacatagatgacacagtctattcctgatcgcactggaggactttatgtgacagagtcctccccagtgaaagattcccatctctctactcttgtcccctgaaatgactacagggacacctgaggagaagctctacagaaatgtcccactttgtgaaaaaagcaagaaaatggtagtttctagggatttgtcctagatcaatgagaacacaaccatgagaagctttgcccaaatggtcaaaacgggagtccagaaggtaaaaaggaaaagaaaaagggggaaaatatggccaactctcagaatatcatagcttttgttgttaaaatagggaatagacaaaatgaaaatagacgggatcataacaagagacccccaccaacactatcaagtggaaggggatctctcttcattggaggttaggattgtagcctgagtcaaagaaaggctaggaaaagaggtttccaaaggttggaaagacttataatcccacatagaaaccctccaagtctctggacacagtccagggatgaggaatgtacaagttgctaaggcttccctactccctgaccaggacaataaggaaagactattcagactgggagcacaaaaagtaagacgaggaggaaaatcccccctcccatgcactcagatcttacctctttccaggaaaaggacaagagatggggccaacatgtcagagaaaaccagcagccttatgccttatcaaggtggaaaaaatggggaatgaattcaaactttaatgggtctcttggatattggtgcccaggtgatagtaatcccagacctccaaaggaataggggtaaactggtaacattgtaggtttgggggatgaacatgatgatccatggcagataagtttatttgtacttatgggcagagccctttgggccatttcaggtagctgtgatcatggttcctaacactgaaaatgtactataggtgttgatattttggccactagcagcgtggaacatcagtgacacctcagggggaattccttctcacaataaaggatttgaatcattacagtgaggcatatccacttctttcctgccagctaagttaaccaagtcccaacaggctatttgacaaaagcaatacctcctagcaagttgagaaaaaattgttagtgtgttaattcaggacttgctgcaggcaggagtgccatataccactctgttgtagtttaacaatccaatatgatcctattaaaaaaaaaaaagtcttacaagcctggaggctgacagtggacaactgcaggctgaatgtcttgcgatacttaacatttatcactgtaacctgggtggtagcaccacatgggagactgatacgctattataaatctggctaatgccttcttcttgacctctctatgggaagaagataggaccagcttgcattcaagctggtcttatcttgaatactgcaggaaagtatctggctgtatactttcatcttactttgacagagataccacaattcccctgcagtttgccatcagtggtagggctacatctgaaaaagtctgattatccccgggagtacttgtcattcattatattgatgaaattctcattgctggcctaaggaacacattgatcaggccctacacaaagtcataagatactatgatacataaggattgggtcatcacctctgataaagtccgggaacctgctcgtcaagtgaagttcctgggaacctcctgggccaataatcagaaaaatgtttctgacaaggttaaatgaaaaatgctgcccttaacagatcccaccaatgaaaagagattcaactcaatggctggcaggcctgtttgactgctggcaataatatgcaccacatgagcatattcttttgatccctctgttgaaggttaccaataaggtggccacctttaaatggagccccaacagcagcagactcttgaggccatgaaccttgccatggcatgggcccagcctctgggatcaatgaagctagccagccttatggaactgctagtctcagtgactcctactcatatagattggagcctatagcaatgagatactgctaccaaaatgacttgacctatcaaacatgtaaattatttgaggcagctcctaggtacaacttcttcaaatggcaaccactagcctgctgttgggccctaatgaaaacagagcaacatatgtcacctaaagacctgagcaacttatcctcatgtgggtattcacaaatttcactaatagtgtaaaataggctcagcaaagctccatcattaaatgaaaataacacatccaaaataatgttagaccaaggcctcagtgagtcagccaactccatgaatatgtagccgcctcactggaggaggtcaaaatacccataggagatacccctgtccctctgttagctaaatgaatcccacagtttaaaaatgttccagctgataatatggcttggttcatggatggatatatgaaattcaaagctgatggagaccactgggccactgcagcccctgccccaaggatggtcatattttgactgagaccagatgagatgttctgctgaatgggccaagtccatgtagtactgatggctgtactggctactccaacagcaaattcctgctacatatttatagactcatgggtcattgaaaatgggctagccatatggtccaatgactgatgaattaataagtggaccattaaaggcgctcctgtttaggaacggggactatgatagcaacttttgaactgcaagagatatttatttaccactcatgtgatacccatgtcatgccacccatgacaaaggaccattcaaaagaaaacacaaatggaatttacaagctgatctagcatgccttcaacaaattttaataattgcccattggattcaccacaaagtgggacatggaagcccaactcagatgcaagaatgagccaaatgggaggactgaccctcaaaaaaacaaccccccaaaatgcagcacactcatatgactcccaccaacaagcccaggctatacaatgcagctaattgagccatattcactggacaggggacccatgtaagtgtgacaaattgaccacatcagaccattagtttccagccatgatttctggtggtgccttatggccatgaacacatacttcagatgtgggactgccatttcaaggcaccatgtaaatgcaaaaactattattgtgacaaaaaaaaaaaaccccacctcagccatgtttggatatctaacaaaacttcagtatgactgagacactgcatttgctgcagaagctgtgcagcagtgtgcacgctcccatggcattggatggaaccccaggagaatggagtgttagcatgatggaatgagaggctcaactacacaaagatcttcaggaaaaataatttagcagaagacatccccatctaaaaaaggcatttggaaattaaacactgcactccagcatgggaaacatggcattgcaacacatgttaagaaatactgagcttagagggcacaaagggccaggtagtgggataattaggctatgcctgtgaaatcccaattttagtacaccaccattctttcattgtttcttctgaaacatactcctcaagggtggcttgtgatctaggctgtagtgatgcaccaatagggctttctgattcaaacctggaggcaacactaccttcgggcatctccctcctgtggtgccccacaggaatgaggaaggggtaaaaatatatggacatgctgtgttttcttggttgtacttggtactcttgatccctcaatttaggcatgtgacattacaggatatgtcaaatttgatcagggcgtaaccttccttcttggattagacaactaaggccaaactatatgggtcaagggacagaaacaatgggtcttcacagaagctgtaacctcacgactatggcaggtagcttgggtagctacatttgggcaatcctcactctaggttattagataagagcatcttccactttaggaggtttgtaaagcaaaaggtgagtgggaacattaattttttttttcatttctccagaagacactgtggtgcctggcacaaaaacaccctgaaaagaaccaggacagctgtggtgaaaagatgcaatgtgcaatcttaaataatgctagattcgtcaccccagactggagtcgccttatcccacactcccattgtaatgggctggctggtacacaacaactcagacccttttcaaatcagtcaagacaaacaggacccactaaactcaccagtcaaggtggtgaacaacctaatggttctaaattgcccgttgtctgttgatggaatgaaacaatgtttgtgttactgccaatacctcttactgtgtgtatgttaacattttggggaaggtaaaaactgggctggaaaagacctaagcccaagcaggatgcttatcagctgtacacctgcagtccccactagactcaattatttacctctttatagtcatcctaagcctaacacttggatttcctggttgaagaccattttccagggagacctggttatcttcctgggtctggttctcctagtgaccctggtaaaatgctgtctcaaaatgacagggaagctctgagaacaaatgtacacatatgagttgtatggggtccacatttatttagctctgcctccaaatttgggttgggcaatggttctaccagagttgatgtcttttatctgttattttggtggctgagtaatagtcaatgggggtggactattataaaagtcactcatatgcatgtagtcttcatacagtgccttggtcacttaagaatgggtctcagagctggaacctttctattcaagagacaaagagccctcacagccttcactagacttatcgttttgtgtagaaatacttttctcttttctggattcaatgtgttctcttttgtcctcttaaagtgagagcatcatatggcacctggccaacctcagttctatactcactcccagcaaagaggtgttgaagtaaacagaggcgaaataaaatttaaaagagtttgagcaaataatgaatcattcattggccagcttcaaaccagaagttgtttagaaaccccaccaagggaatgaaaggagcagcttttacagaagaaacacagaagtaaagcagagaaagaactttattgcttatagtcatacaactgacttattcggtctatgcctttggaaataccttaattatataattttaagtttgctacttctgataagttgagttgaagttctgtttttcttcaatatagatatttacaagaaatagctgaaattaagttttgcttatgtttggaaatcaagcaagtttgaggtcacttatgagacctaactatttttgtctgcatagagattcttcaggcctggtctccattttaatttactttaacaatgctccattttggttatcttctcaacaagcaaatagtatagtgttatgcacagttatcgctattgatagactctctggaatgaagagtcatatagatattttcatcatcaacaattgcattgtgatgtaaggtcatatagtgaccaatatctatgtcataggcttgagtggttgagttgttgagctcttcaatttgtctaaactaatgacaatcatttgatgtgtaagtggttgctggaaagcatttaaaaatatgtttcaaagcccttgaggaaatacaacgcaacagggaggtgaatacaatgactttaaggagaataatagccaaatattgaaaaattctctgaaatagggattgacaggagccaaagtttaaccaattaaataaatcaatggaagaggcggcacctatctgatgaaagatatatttgctccttaaaaggctttacatttagggaaacaatttctaatttattaacatagaaacaacatttttatcaataagagcacaagcttctctttcttaagctcttaggcattaaaggcttctattttggagtactactgaggctaaattgtacattacaggtattgcctggaggaaattcaaagtatcatcctatgaaaacaaacaataaacaaatttttatatttggagaaaggtttgatcttaatttttgatttcagaggacagctagtcaagatttctagatctgagtttgaagcatctttagattgtgaaatgacaattacagtggcaatctgatgtattttcctggtttgcagttttgaatgtctctggatatgtcatttggtgttttaatgaactctcagagtaaacaatataccagtaggcatgaaggatgtccacacataatatgttgtactgatttttatgaggtttaaagtcttccagtttcagcttgccaggcttgggaaaagagcagttttagttttttgttaaactagaaaaatgtaggattcaattcagtttacagttggataagaaaacctcaaagaaaatgaacaggaccagaatctgatcatgggtgcattatagttttctattaaaacataatctccttttttcagtggtttctatttttgtcaaaagtaattacaaaataaatctacttttatctaacttgagtatttatatatgtaacaagaataataatgtcatgtatattttaaaataagatattttagctggagctttgttagtatccaagggtttttattgacttagtatcagtcagccttaattttttaaaactagctggtaatgaggaatctttggttggacttttaaaaagctccatgggctaagaagctaaggcaagaactaacccaattatgtcctattacaaggaaaatagattctaattgaacttatggatattctcatattgccataaaaatgagaatattcctacatacttttcttttttttttttttttgagacggagtctcggtctgtcgcccaggctggagtgcagtggcgcaatctcggctcactgcaagctccgccccctgggttcgcgccattctcctgcctcagcctcccgagtagctggcactacaggtgcccgccaccacgcctggctaaatttttgtatttttagtagagacagggtttcaccgtgttagccaggatggtctcgatctcctgaccacgggatccgcccacctcggcctcctaaagtgctgggattacaggcttgagccaccgcgcccggcccatacttttcttattgatgcaggatttttctccttcactttgccagccagggacctccatttggtgatgctccctgcctgggcctctcttaggcatgctacctcctgtgggaggaagccagccaacacagcccacatgggacatgcctggattgtgcaccggtgcagcctgtggctaggccgggcatgcccccgcctgcctgtgtcatagcttgtacccacattcggcagttcccgagttattttcccacatccaagaagaatgaagatacactgacaattgaagagtgaggagggcagagaataattttattgagtgacggagcagctctcagtagacaggggtcatggggtggtcctccacccaaaatgaggtggtttccctttcagtgtagctgaatctgaggcttttataggcacagaatgggaaggggcaggtcactggtagcactggaaaaggtaatatttgattggttaaaaagcactattcaggaagaactaatccggaaagagtgggcaaacaggaatagaatttctcactccaggtcacaggtttcaggctgtttttggcttaaaggtggggtttcactggggaccttctcctgtctgcctagaatttgtctgcctcttgcctctatctatctcccatctgaagaggtacatctaactgccattaggataaggacaatggccaatcttaactgtttcctgttgacaaggggcactatttggggaaaacagcagtcagaggcctatctaagggttcctggtaaaagtcagccatcatctgaggctccagttgcatgaccttttggagtttgatggcctgaaggcaagaagagacaaaccagattattagaagcatggatcaaagtgaaacaaaaaagtaaggacagctcaaaacccctgaggctgccaaaaagcccagataactggtggctattgttatgtctactaagatctgggtgcatggtgtttggctttggttagcttccttgcttttattttccccaaaaagaaacctcttcgttatgtgcaacctatttattcttatcaactcgcaggatttgcaggatgattgcctggaagtagaatattgatacagatttttacattacccatctctcttgttccttctgagctgcaaccagagatcactggttggttgacaggaataagcagggttagtccaaaatgtagacaaaaacttgaagacaactaatgaaactagaatttaatgacaagtgtataagttttgaaacataacttttctctctccagtcctcatttgtctgaaaaacaaatcatgataaggctgagttgtttgcaaaataaactttaattttatactgggcctgattatttgcataaagtgcagcaagaataattattttcacataggattttaaaaactggcttagatggaaccctgttctataaggaatctcagataagacttttttaagccgaacccagccatgggtttgtacccacaaatacctatgagttgggaaaattcctgtcttattgaggtctcaagaaaacttggggttcctgggcctattagaaagtgacattctttactcatcacaggttgggaactctgtacagggactgtgtagacaaggtatgaggccatttttcccatgaggcttttattggctctgcaagtcaagcttgatttcttaaagggaaagatgaccttctagtcaaaaccttggtgaaacaaccagtttttccaattgcatcctgttgtaaaagaaatggattcttactgcaatttgcaaataattatattgccataagttaagaatattcagaagcagcttccaaattttgaagagaccaggcagagagaaacaaatatgctccaagttttgttcacaggaatatatcttattcaaatattaaaagctataaatagctcaaaataaaagtttttctgactttgaaaaacaaaggatcagcaacattttaagcaaaaagttaaaaagaattacttcagttttctgttagttcatattattccattaactcttgttctacttgatattcatgaacatttcagctcttcatgagtcctgtacattttcctctattccaatgtcacaatcttaaaaattatcagaaatctgaacttaagagcacctgtcaaagtcccatagctaattagaaaccatcttttgaaaaggatcaaaacaagatagcaattgtctgtgaatgataaaaatttccagggtagttatagataaaaacaaaattgacaaagaaagttggttatttctgcagtttataataatttaacataataactctaattatgattgatagcatatattcagacatcagaattttcaaaatctcatatgatttttgaacatatattattattcactaaaatataacctgaagaaggttaaacattagttttattttggctctcccatgtaactaaacaggttaaataatcctgtttatctctattttgaatgtttcagggccctctgaggcatccaaacattagtggtcagaaaagacaatttaaaagctgaaacttgattttgggaagcctattaaatattttaaaggtttaaaaacactttgatattataaaaaataattcaaagttaccttaagtaacttatttcgtcaagatgatgactccaagttttatttaaaaggcatcaacctttactcattaagagggaagacagctttccaaacaacgtctcttttatttcccttcttttttcagtagtttatttgcaaggcaaacaaaaatattccattatcctttaatattacatgaaaatctcattcaagagagggaaaaccaaatttcaccctcacattagtctactataaatgtcaactacagtttttttaatgaaatataatagataattctatccaatcttaatctgtttgtccatgaggtgagattcttataaaccttttataaccctttataaatttttttaagaccagattaatgccttaagaaaaccttgtttgtttttattacaatgcttagtgtatgaaaaaaacaaataataatacctttttgaacttagtcaatatgttaatacacgagtttattttacaagattaatttttacaaaccttccacaacttgtttaaacctttagttttatctcatttaatttaaaacagtcctttaaccatctaaactaggcaaaaattttacatttccatgccttcttataatcttttactaataacacatcttactttccttaaataccttgcatgcaatctcttttcagtaatctccattatatgttataatgataactcttagcaatttttaattttaatgtaaaacctggtaagttgttttaattctgtactaggcacagataaagtctgactgtttccagcatagtcagggatgtggttaactccatgtgtccccaggccttaccaaacagtaaagcaggcaagtcgaacaattttcaaaagctgaagaaagaagcagtttatgagcttaaagcatttagtaaacttagtatttgacctgcataatttagaccatgtatttacatgttgaagacatttgtattttaccaataatctttaaaactgctttttatttctcaaaagattaaagtcatgtgaactaaaagacattgcagcttttatttttcctttaaaaatatttgatctaagtgcttattttctttaagtcaatcaattagagctcttgtttataaaaacatcacatatataacacatatgtaactacacagacagacagaaaaagatgcagtagttgtaagacttcttacttgccaatctcctaattggactactggcctctgtgtggagcccttgaagaaacatggctaaaaaacccatgcagtttctagggcctaataagcagatatagctggaggacaaaaacagattttgagagggatttatccacttttagttcttggggctccatgaagaaaacagagttttttttttcctaaaatggggtccatgatgggttctgtttttcccatgtggtcctacgctatcagaagctatcttaggacctctcttgcatgcattaagattggaaagacaaaatggagaaaaataattcagttgactgagaagaaaaagagtttttccaacaaaacaagatccaagaagagaaaaaaagacataaaggctttttaaatatacctatagcttggctattcactcttaattaagattacttttaaccatagagctctttaaaaaaaatccttttaaatcctttataacctgactttagccacaccaagtaggcaatatttctggcttttgaactttatcaaaagtaacctcaccagtgaaaccaaggagcctcaaaataaggagatgacttaactgcaagtgtatgaggtattttcaaagaagtgataagcagtttttacaaaatctagaatcttgaaaagtagctcagagaaaggaagatttaagaaagaaagctagatattgttcatggaggggaaaagaatgagcaaatggtaaaagtcccatagatattaaccagaaagtactcactacttaaaccaggtttgaacccaggctgccattgtaaaatggcagagatcaaaagaaagtagagccacgtagttttaaggtcaagctcccaaggacatacaagacaagagggaaacttcgttcagctttttgtttgtagcaaagtttgttactgaccaatttgctgggctgacttgaacagtgggcttatagggtcctaggcccatgttctatactaaggtattcctccttatgacagaaccatacagaaagacacacaaagcacaccagattggctacagtttaagactagcctcacaaatcctttttttccattaatcaaaaactttacagaggatataaacagtgatttttgccattcattcaaatctctcagtttgcacaaacagcgagagagagaagccggaagtctgactagtaaaaaacttttacccctttgctggcatgtcaggattctgggatctctcccccgaagctatggagcccttttgactctggagtcctgtaaagggggagcaaaaaagacattatctgcatattgtaaaagttgtccctcctgaagagaatgttcagttaaattggtaattctttcccagttcatttttaagccagtttaaggtttggggaaattaagcttttcctgatttaggggatgcttcctaggggagtgtcctgtggtacagagatgcgatttctctgtgaagagaggacagaggaggaaatacgaaaaagaaggcttaaaaaaaaaaagtcccagtgattcatgatgcattcaagagaaatacagactgaagatggttggttacccaactggaaagaggaagaaaggcatcccttactttctttctgttcccagcgaacacccagggtaggtgagggagaggaaataaaaagcttcccctttttttcttctgtccttctatccctgagttctggcaatgcttggcaggtgccacccatgggtgccaatgcagccttcacccatgtaacagggatgcctaaagggtagaaatatttgcactcacctctgttctggtctatcctccctgccatcagtaacctttgagttctctagacctcatctatgctatgaatatgggcaggaccttcgtccatgaaatggagggagtgtaactggaaggaattagtcatgcttatctgccctgtgcccttagacttctgctgttttcctttctagggcttcaacctgaagcttggaattgagtttgggacaaaaagttacctaaggaaggtgcatggactcactaagttaagtctcaagtggtccttgccaaactgcagccagtattcagcggtgctactccttcactgctttcttatcataaacagtgtgctaaggtgaagttgtggaaacaggtcttcctcaaaggagggagagaaagaaagtcctatgaattggagacctcgtctagtcaggtgcctcccaaaatcagcaaaaaaaccctcacacatagaaaagctccctgtattttatttgcagggctatgtgaactcttgacatcatggagaaaaaaaaatatgaaacagcttaagtgcagggaagggataggtgccttggggcaaaaagcctattgctgtatgcaaatggtttccttcaacagggggaaaaaaacctcttaattgctacatcctctccacttctaagaataaacagaaactgcattgttctgaatcacattttagatgactgggccaactgcctatcctacccagtaatgtatctgtagcctgcaatgacaccctcaacattataaaaaaagagataggtgccatcacagcccccaaagaaagaaggaaactgccatagaaaagactaaattggaacaaagccaatattcccaacccttgagagcaacaggggcagtggcagggtcctctccagcaccctgtcttctgtagctgtgtgttcactcttaactggctaatcagaggttcagtgcttcatcagccttcagaaaaagtctgaggacaagaaggcttggaaaaaaagtgaagagtctaggtccacatttactcacccttcagggatcccagatgagtgcccagaaatgacacaggatttttctcagtcactttgctagccagacacccccaactgaggccttgcttgggcacactacctgctgcaggaggcagcccacacactcagccttcccaggccatgcctggtttgcacactggctcagcctgcacctgggccaggcatacccctacccacctgtgttatagcttgtacacacatttggtagttcccaagttgttgttccatatccaagaagaatgaggacacactgataattgaagagtgagaagggcagagaataattttattgggtgacagagcagctctcagtggtgaggggacacaagggtggtcctccaccgaagtcaggtggtttctctcaatgtgtctgagtccagggcttttataggcacagaatggggatgagtgggccataggtggcattggaaaagataccatttgatgggttaaaaagcgtttctcaggaagaaccagttgggaaagagtgggcaaatggaaacagaagtcctcactccaggttgtgggtttcagactgttttttggcttgaagatggagtttcaccagggacccacttctgtctgcctaggatttgtctgcctcctgcctctatcattattaaatgaacatcctactttttaatgcatatttatatacagttttatttcttgcatccttattactgatcattttaattgtatatattaattaaaatttttaatccttagtaactccaatatctagtgaaaataaggaagtatatgatttcactgtttcaatagcatgtggctcctcatagtttaggacatgcttaccagcagactcaaatatctctagttcttctttaaaataagccaaaaatatgtaaagttaatattatcttcagaaattaacatttagttttgttttaagacagtattgctgtgttgctcaggctggtctcgatctcctggcctcaagtagtcttccatgttcattggcttttcaaatagctgggattataggtccaagccaacatgcccagccaaaaattaatgcttttatacttaatcttatttggagataatatagatacttaataaatatctattatttaatttaacaaagtatagttttaagattttaagttatcaaacagatttttaaaactgtttttatatagacataacattaaacaaaactgtcatctcaagttacttttcttgttgatacattttgtgacaaaggtaacaagcttatttgattagtaaagctgtgtatctttgtgacaaagaaaacaagcctatttgactagtaaaatattttactaaattaaccaacattcttatttattaaagattacttaagtcatgaacttgaaaagcatttggataagtacctttttttctgagaaaataatttatataaatgctcattttttccttagtccaattaaatatagctctttcaagattatttgtaataataccatctgagggtggaatactattacaaataagtaaataatatacatatattaagacatacataagcatacaaacaaacacaaacagacagtcatggcttctatgctgaaattttagctatgtgccaggtacaataatgtacttactcactagctagatccaaattgtgtctctggtagttatattggcctgtttagatggctaacgccttctattgatatttgtggaagaaactttttagatttttcatttgctagttaagttcttaaaagtttccctttttctactcagtttctgacaagtcatttccctgaggccttttaatgatttagacatctcaaaggcagagagaaaggatgttaagtattctccaggaaggagttctgggcatattcgcttatcatcaggagtcaatttattgagactgtgggctaaattttagatgaatgactgaggagacatccagtctctttccaattagttttttttttcctctttaccttaagcagttgcttttataataggttggatttatatgcaagattaagagttaaaagttgtgtttgcagattcttctgtcttatttgaagatctaatttttaaagaaagttgatgttaaagattaaggttaatttttcattacacactgtaaagattcttttagagaaactaatttttcgagtcattctgggttttggaagcttctacataccaatcaaaaaatgtatctcattgtttctgaggttttgggggtcctttttttctaatgcacccatacaaaaataatttcataaggagtaaaacctcttccttgttgctactgtaattccttgtcttcctgaggtacaccaatttctttagaaagacctaggtctgggtccaagacttctgaacataaaattagctggagttccagattaaagtgtcctagactccttggattctgatgaaccgataatactttgccttaaattttgcttatcacaggtctccaactgaaccgagtccagttcctgctgaacacaatttgacttctggatggcagtctggattctgaacctcgcccttctaacatggaagcacatgcactagactggaccttgtccagttttgtcaggcccagtctaacctctaaaataaaaattgctcaaataaagttagagagctaaggacacaattttcagatcttgacatccaagaaggacgtacccagtgaccaccaaatgtgatgagaaagcagtgagcactatgggctcagcagatacttatacctggttactcatccctcctgggggtcatcagggatcccttttacatttctgaaattaaacttttaaaagataaattgaggcactataaaattttaaagagtttatttgaggaagcattcattcatgcatcaggcagcttcacatcagaagtggtttagcagctccaccagtggcacacggcagggaagcttttaaaggagaaacacagaggtaaagcagagaaaatgtttggttggtttagtgacacagttgccttatttggactagtccagtggaaaatccgtagttatataattataagtatgttggccacttctgcttggtggagattaaatttgatttttccttaatatagacatttacatgacataactccagttaagttttgcatatgtttggaaatcaggtaaggttgagatcacttatgagacttaactgtttttgtctgctcaaggattctgcaggccaggtctccactgtaatttactttaacaaaggaaatggaatatgttgcctgcagcaaaggagaggaataagtggaagtcatttgcctgcatcagctgagaagtgagatccgctggccatgaggaatcaatgctattgaagcttctctttctctgtctcttttatttgtgagtaaaacattgttcgtccagtgcctgagatgtctttcttggtgactctgatacctgaaaatcatggaagagagtgacatcctggaactactgcttctggtggtaggcactgatactctctatcctccacgcagtgagacccctcccttggaggtggtaataggtgtcacttgctggacagccttcaattaaacaacagtcatctttaggtgttttataatccccttatcgctgaacttcatatgatatcctaatttacagtttggtcaaccctgctggtttctgcaaatgtattggcagtgcttattccacggagtagacaaacagatgatagaaaatagagtgatagcagaaccatccaatttaaaacgccaattgaaagagaaagtctctcccagttgaagcaatgttaattgaacaggggctccctctgatgaaagctcttgacagaggacaatcttgctattaattttccatggtcttttctgtaatgtttttcagcttctcccagtagaatggatctaacaactgtaatctgaaacctttctctcccaatgaacacagtgaaaaacaaaaacagtcatgaggcaaatatgcgtataagagaaaattgcttttgaagtggtaacatgttgtataattcctctccaacctgtggcagccagtacaattttgactgtagagcagagtataaatcatttctttttatatttaaagaaataaaaatgtactatatatggctctaaaatggtaaagattgaaagaaaatgtgaaaagtactgaacccctcaagggatactctgtgtttgaaattctaacacagagattctaacccattcatctcttatgaaagaaaataatcccaaatcacacaggaaaactgtcagtgctgtcgaatatcaatgagcaactcatcatcaatcatcaacattttatctctcaggaaggttctgaaaactatccaaaatatcgttgaataaccccaaggctaccgcaaatacttaatgagatctttgaggaatcttttgaaattttgtttttaacgtttaacatcttcgttgtttcacttgctctcgccacagttctttacagactcttgtgactttaataatcttctttattatttcagagcacagtggaaatgaagacaggctttgtacatgatttataaagtgtgtatcactatagcaaccatactgtaattctgaaaacaggcatctttataagaaactcgatgactataatgagaaatgaccacaaatggcagtatagtttattttttagcttattctgttttgcatgattgcctgattttatttatattgtcaagtagtctactaatttctatactttcactaatagtagattcagtatgagtctgccaattttatgtgaattcatgtagaaaaattggttcaatttttctgagaaactcctatctagcaaacttaagtactctaaacaaaactcagtgcaaagagataaaatcttcagttttaattttttcccaagacaattcccaaatgttacaaattaaaggattcttagcattatgaaagtaaatcagccagagtgttggttacgttgttcaacagcaaaggaatgttattacctcagtgactgaagttggcaagaatactcttgcaaatatgttaagcaggcaataaggtatcaaacaacagctgagcctcacctaggtagcaggacagaagcaagttatctggtatacagatttctaggtagacatagaattcaggacttcagttcttcattgttaaataaacattcattaaatagacaattattgcacatataccaggcagatacaagagaatacagataatacaacaatgcggagatgaatgaggtccctgtattacagggagcttatggtttggtggaatacaaagcattaaacaatcatttaaaaatattatctcattaactttgttgtaagtgacatgaagaaaaagtgcaaaatggaatgatggtatattgggtcttgaacaaatctaacattttacatgtgtcaatactaaaataaacagtaggaatctattattgttttcctattgttttttttttcaatgaataagaaggaaaatcaatgattttgacttctggtagctttctaggtgtatgatttataaatagctacctgaagtttatcatagtaagctaattcaattgtttttaaaatagaaaaaaatttagcaaaccacatgatatgatggctgtgttttgttctttagtttgtggagtggatcagttgtaataattgattctagtggaatatttacatttatctctgtgtgctctattgtttgcacatattttcaccagcttttctatctatgcacaatgttcttctttctaaaatttgtatccaaaacttatatcttctagattaatcaaaatactatctcatcaatggggcctctcttttcaatgacctatcatatgatatttaaagcaacactcgttaaaattttctgaataattaaaatatatgctcactgtagaaaatatgaaaatcacaaaagtaccaagtacattaccttatctaaagaagccatcaatcaataattatgtgagtttgtgtttgcatgtgtgcatagtgagagactgcctcaattacaccatactgcatgatagtttcaaatttagtttaattatttttcattgaaaaataattgtatatattaatagggtacaatgtgaaggttcaatgcatgtacacattgtggaataatttaaatcaagctaattaacatatccatcacatcaaatacttattatttatttgtgatgagaagatttaaaatctaaaaaaagaatattaaaattacttatttaaaatagcaattttgaaataagtaatatatcactgttaactacagtcaccatgctgtgcaacaaatcactaaaaattatttcctctgtccaactgaaactttgtaccctttgaccaacgtttcctcttttcctgtccaattcccccacaacaccagcctctggtaactaccattctactcatggcttctgtgagtttggctttttcggttttacatataaatgagatcatgcaatgcttgtctttctgtgcctggcttatttcccttggcatagtgttcttcagattcatccatgttgtgccaattgacataattttcttttttttaaatgctgaatagtatttagtggaattgtattcaactgtatcccaatatgtcacattatctttatccattcatccattggtggactcaggttgcttccagatctcaggtattctgaataatgctgcagtgaacatgggagtgcaggtattgcttctcactgaattcaattcctttggatatataaccggaagtgtgattgctgtatcatatggtagttctatttttatttttaggtatgtttcaccaatacctagtttattgagagtttttaacataaaggaaggttgaaatttatcaaagcccttttctgcatctattgagacaatcatgtggtttttggttttaggtctgtttatgtgatgaattatgtttactgatttgcatatgctgaaccagttttgcatcctggggtgaagctgatttgttcatggtggataagctttttgatgtgctgctggagttgttttgctagcattttattgagggtatttgaattgatgtctatcagggatattggtctgtagttttcttttttttccttctttctttctttttttttttttttttttgcatctctgcaaggttttggcatcaggataatgctggtctcataaaatgagtttgggaatattctctcctttttaattgtttggaatagtttcagaatggtaccaactccctttgtacctctgatagaattcagatgtaaattcatctggacctgggcttttttttggttggtaggctatttcttactgcctcaatttcagaacttgttattggtctattcaggggttcagcttcttcctggttcagtcttgggagagtgtatgtgtccaggaatttattcattacttctagatgctctagtttatttgcacagaggtgtttatagtattgtctgatggtagtttgtatttctgtggggacaggggtgatatcccccttatgattttttattgtgtctatttgattcttccttcttttcttctttattagtctagctagcagtctaattaatttttttcaaaaaacagctcctggattcatttattttttgaagtgttttttgtgtctctctccccttcagttccactctgatcttggttatttcttgccttctgctaactttgaagtttctttactcttggttctctagttcttttagttgtggagttaaggtgtcaattggagatctttctagctttttaatgtgggcatttagtgctataaatttccctcttaacactgctttagctatgtggtacattgtctcttttttctcattggtttcaaagaacttcttgatttctatcttaattttgttatttacccaggagtcattcaggagcaggttgttcaacttccatgtagttgtgtggttttgagtgagtttgttaatcttgaattctaatttgattgtgctgtggtctgagagactgtttgttatgattttagttcttttgcatttgctgaggagtgttttacttccaattatgtgatagattttagactaagtgccttgtgttgctgagaagaatatatattctgttgtttttatgtggagaattctgtagatatctaccaggtccacttgatccagtgctgagttgaagtcctgaatatccttagtaattttctgtctcaatggtctagtattgacagtgggatgttaaagtctcccattattattgtgtgggagtttaagtctctttgtaggtctctaagaacttgtttgatgaatctgagtcctcctgtatggggttgcatatatttacaatagttaacttttcatgttgaatttattcctttaccattatgtaatgctcttttttgacttttttgatctctgttgttttaaagtctgttttgtcagaaactaggattgcaacccttgctttttcctgcttctcattgcttggtaaattttccttcatccctttattttgaccctatgtgtgtctttgcatgtgagatgggtcttttgaatacagcacaccaatagatcttgactctttatccagcttgccattctgtttcttttaattggggcatttagcacatttacatataaggttaatattgttatgtgtgagtttgatcctgtcctcatgatgctagctggttattttgcagacttgtttatgtagttgtttcatagtttcattggtctttgtactttactgtgtttttgtagtggctagtaatagtttttccttctatatttcatgcttctttcaggaattcttgcaaggcaggcctggtggaaatgaattccctcagcatttgcttgtctgaagaggattttatttctcttttgctgatgaagcttagtttgtctggatataagatttgggttaaaaattatttcctttgagaatgttgactattggttcccaatctcttctggcttatagggtgtctgctgagaggtccactgttagtctgatgggcttccctttgtaggtgtcctggcctttctctccggctgcccttaacattatttccttccttttgaccttggagaatctgatgagtatgtgtcttggggttgatcttctcatggaatatcttaatggattctctgaatttcctgaatttgaatgttggcctgtcttgttaagttggggaagttctcctggatgatatcttgatgtatgttttccaacttggttccattctttctgtctctttcaggtaacctaatcagtcataagtttagtctttttacataatcccatatttctcagaggttttgttccttctcttcctctaatcttgtctgcatgtcttatttcaggaatacagtcttcaagctcttaaattcttttctccacttagtctattcagctattgataattgtgttttcatcatgaaggtcttctgttgtgtttttcagctccatcaggttatttatgttcctctctaaactggttatcctggtaaatggctcctataatgttttagcatggttcttagcatctttgcattgggttagaacatgctcctttagcttagcaaagtttgttattacctaccttctggagactacttctgacaattcatccatctcagcatctgcccagttctgtgcccttgctggagaggtattgcaatcatttggagaagaggcactctggctttttgagtttttagtgtttttgcattgatttttttctcatctttgtgagtttatctagctttaatctttgaggctgctggcctttggatggggtttttggggagacattttgttgatactgttgctgttgttgctttctgttagttcgtttttcttttaacagtcaggcttttctgtagggctgctgcagtttgctgggggtcttctacagaccctttttgcctgggttcctcctgcacctggacgtgtcaccagtggaggctacagaacagtaaagatggcagcctgccccttcctctgggatctccatcccagaggggcacttacctgataccagtgggaacgctcctctataaggtgtctggtgacccctgttgggggtggtggttatcaccaagtcagaaagcatgagatccaggacacacttaaggaagcactctggctgccccttggcggagggagcatcctgcactgggaggaatcccacttatctggactgccccgattcctcagagtcagcagggagatagaataaatctgctcattcacaaagaccacagctgcccttccccaccagggactcagtcccagggagatcatagttctgttcctaaactcctggctgaagttgcttaaactccttcagggaggccctgcctggtgaggagggatgggtcagggtccagcctaaagaggcagtctggccatggtctgccacagctgctatgctgttctgtggggaattcttcctgggtccaaactatccaggctccctggcagcagcaggggaaaaagggaagactagagctgcagtgatggttgccatccctcccttgggaggacagttgtcttaggcagcaggcaaccacaatgatgatagccacccctcatcctgggaactcagtagcctgaggcagtttccagccaagtggctgatgagaatctgcacatctctgtgcttgggacccaagtccctgctggcatgggctcacgaggaggatctcctgatccttaggttgcacagatacgtggaaaaagtgtggtttccagggcagagtagcacaatcactcagccttccttggctggggttgggagctccctttcccccatgtggctcctaggtgggccatcacaccaccctactgttcttcactcttcatgggtcatggcaaacacctagtcagtcccaatgagagaacctggataccttgctggtgcaggatttacttgccatttacattcttctcagtgagagcctccagccgtagctgttcctagtccctaactccttttgatttttgtagacattcttcactcagaatatgcctgaccaataaagaagaatctgagtattcatgagccaattcagtgaggacttcagcctgaagtcttctcaggcttcattaaaagtaatagccacactgccgtatagacatcactagctagtcgcatagcctattcagatatgcatggcttatataccatccagaggaatagctgcgactcatcagtattgagtatttatttctcaaaataaataaccccaacaagggggtatatgtgtttgtttcagtagaaagtcctcagctagattcacatttatattggatcttgtagaggtgagcttctaagaattctttgagttatcatttagggtgaattgacgagggagtacatctccccagtatccctgaagctcaaggagaagtcacaaatccattcgtaaagccttcccttctactatccaaaccttcagctgaccttgaatacattctttctcattgtaatgacagtccaagtatgtcaactatgcatacgaaggaaatataggtcaactagctatctttctaaaatttctaaaaagttttcatacttaatatatttcacttcctaagtatgatctcttaacaaaaagacaaattaaagaaaatcattttttaatttaggctgccctcatgaagatactacctttgtctagtgatattagctaatttcaactttagtcattgtcttaataaggtcacaattagctataaaactatgttcaaaaaataatggctaaggtcatgtcattttaatattaaaacataggcaatatatttagcttagagatcaaaattcaaaatactcaattaaatattcaaattaaaatttatttgagtaaaaatacccaactaaatactacatatagttttggccattattctggtgcccaaatgagaagtgagacacatttcagacaccatttattttaattaataagaatctatttataaatgtaaaaatactgctaaggacttctgataaatttaaggttttgttgtcagttttttataaaacctattattcagaggtttacgactgctgtaaaaattgactcgaacaatttagcactaagagaaattatttctaaataccattctaaaatataatatctgactattctgaaaaaaaaaaacttcaaggagagaaagggggatggaaagaggacaaacaatattactttttatatttaacattttaaacaaacatggtttacaccaagtgcagcatgtttaaagacatttagaagctattctatttatctattattgtgtaacaaaactatgctaaaatgtttgcttcaagaaacaaggatttattctatctcattatattgtgggtcaggaatactgatgtgactcagctggatacagatgcagtcccatggtggatattcagaataccatgttgctgactgaggtcttttcctggtatcaggtggctgagctgatctggaaagtccaagctgctccattcacatttctcagggcttggcagttccggctggaaggaaaattcagcacagacacctcctacctgtctctgtattcttaggcatttccatgtgatctatccagtatggtagtcacatatcttatggtaattcagggcaccttaagcaagtgtcccaagacatccaggcagaggattcaagacttcttttgacccagccttggaagttcctaaactcactccccaacatgcacttggtcaagcaagtcagcaagaccagctcagattcagaaaaaaacaaaattagacttctctaagtcaaaggagtagcaaataattgtggccatttttaatcttcaaccaaaagctcctatgttactggtgtaatcttagaaaacatcagactgtaagtcaggtgacttgtttattcgaaactctttgatgaactagctttatgacacttatgttatatgacctctctagttttaaatttacttatctgtattataaaatgcctggattagagttgcaaaatatcttcctaattttaatactggatcactaaattatattcttttcatttaaaaaataattcactaactttttaatttctacttttgtataatctctttcatctttttaattatattttgatcttaaaattgcctgggagactagtagaatggtagaagtggcaaggactgcaagagtcagagattttacctacttacatgctaacaagttagcctgcctcagtttcatcattgctggtagatgtatcaccagctgtatcctggtgatacagctctgatgagtggagaacaccaggttcttcttctcaagtcgaattagaaaaaaacgacatggacacacttggagtagttttaaggagcagggagtttaataggcaagaaagaaaggggaagaaagaaagaagaggttcccctgtgcaaagacagagggaggggagctccaaagctgagagagggaaccccacactttggtaatatcagccaactctattcaatggctggaggaggaggtgtctgatttgcataggagtcaggggattagtttgaccaggcatttcatacatgtagcccacaaaaaaaatggccctcccgccctagccttttaatatgcaagtgcagggcaccatgatgttccgcacacgtggtgatatgtgggcacagccatgctgccagacacatgtaggggcaagggcaagagggcaacaatgggaatccccatgttgggtggacccaatttctaatggcttgcatttgcatatcaaaggttgcccccagggtctaaggcccaggactttcgtgctagacaagagctgtgaaaaatcttccaaggactcctttttccctaactgcctaaaatactttcttaataactcctacatcattgggtcatagacaaagatatgatttctgatggtataagcttcatgtttccattagttcctcttgccccccaagtcccatgggtgatgcaggttgacccaagtacatgctgtgcaaacagtgggtctttgtcacagctaagaaaccttgtacaaagaaaacccttcatcttatgagggggtagcaaacctgcccaaattttgtccagacagattatatgtattatctttattatcctgaaacaaatctactctctgccctatagggagaagctacctctgtctttcgagatacattatacaaacattcttgaaaagatagtctaaccaaaaatgctatcaagatttttgctcagaagatacgcaaagacacaagaacccatgaagaattatttcctcatattagggggacagaaaattatcatggttattgggaagaaaaaaggacttcaaaaggtgtagtcgttcctacttttacaaagtataacccaatctaacatgccaccatttgtagaaatcaacacatacttttcaagttaaaaacacagaggaaaaaaaaacatgaaaatttagcattttgatacatttaagaacgctgagtgctataaaatgaataagaaagaatacctgaaataaataggaaatcacagatgcatagaaaaacacttgcttattaacaaaatattttatagcattttttcattttctagtcaaatatttattcaatcaacattaatatagattaatatttcatgctgcttagaagagtggcatatggtgattcttaagtaattccaattatgctacctttaagaataggtggagtggaaggatggacatgtgagagaagttacaataaaaataaaaactgtgacaggatgtacaatggtgttggtgggatatttgttatatcccacagattttgtgatatttaataactccatattgttttgagtaaatttttcactaaagtatgataaagggaaagctagtattaaggggcagattatttaatttttattcaagacctttccatgcatgtttcaaggaaaaccttttcatgtgattgatttcatgagtagtttctcatttaaaatgctaaaatgtaaaaccttttcatgtggttgatttcatgagtagtttctcatttaaaatgctaaaatgtaaaaccttttcatgtgattgatttcatgagtagtttctcatttaaaatgctaaaatgtaaaaccttttcgtgtggttgatttcatgagtagtttctcatttaaaatgctaaaatgtaaaaccttttcatgtgattgatttcatgagtagtttctcatttaaaatgctaaaatgtaaaaaacattgagaatggaaaagagtgattcactttattctgctttgaagggattacaacaaaattgtttcagtacccaagagatgcaaatgaaaaagaaaaaaacactcaaatctgaactaattgctataactgatatagtttggctctgtgctctatgtccccacccagatctcatcttgaattatactcccataatccccatgtgttctgataattgaatcacgggggtggtttcccccacaccgttctcatagtagtgaataagtctcaggagatctgatggttttataaggggtttctgctttcacttctttctcatttactcttgccactgccgtggaagaagtgcctttcacctttgccatgattgtctgcagccatgtggaaatgtgggtccattcaacctatttttattccttatcttgggtatgtctttatcagcagcatgaaaatggactaattgtgcatttttcagcaacttagtatttttgcatagttataaggctctaaatacctgattctggtaataagtggctaaacttttctcaaatggcatatatgttctatatggagaatcatacctcctgtgcagttgtttgccatggttatcctttaacagtattgtaaatctattacatacttcttattagtcactgaagttctaagcatggaagtactattttttcatgaatgcaattaatattttacagaaacagaaaaaaaagagtaatcataacaaattctcttaatgtttccaaaacgtccaatagaacttctcattcaaactagaaggcagttgaggcagatggccaataaatgtgttctatctgatagttctctaaaagtttagctctgaattgaaagtttgctatcagagtagatagcttttttccttgcacactattggtgggaatgtaaattagtacagccattatggaaaactgtatagagtttcctcaaaaaaaccctaaaactagaattaccttatgatccagcaattcacttctgcattcatataattttacttaaaatcactatgtcagagacgtctgctcttgcttgttcatcacagcactattcacagtagccaagttacggaattgacctacgtgcccatcaacagatgaatggataaagaagatgtggcatgtattcatattactcagtagcttagaaacaactttttttttcctaagggagaggttcctacaaacttaatgagtgttaatctgccagtaacaatatttcattattgaatttaattttataccttcttcaatgcatgttttgattttttaattgtctgcttacttaaatgtgcaacgtcaagacactcataggagcatggtattatatgcattaaaagcctaaatgctcttctatacttttgttgagggctactaaatctttaggttaactgatctccagtttaggggattctatagctgttttctcaatagttttaagtggtgcttccaaggattaagtgacatttctttggagtcagtaatttgcattcgagataacttgactgcatttcagttatactgcactgctcattcacatgattcatatcaatgaggcagtagtgcggtgaaggtgaagatcagcagccaggtggaatcttcacttgaaatagaacttagcctgcttaggatgtgcattaaggcttggtcacagcctgatgaacaaagagcaggacaaggtcatgattaaacaaattgaagcctttgtctttcttaacatgattcattagtggtttgcttagtgttgcgttcattttttaggacttatactcaggatattgtattaattacctaagtggaatctaaccacaatgttaggtctgtttttgagctttgatatttaatacagattaaatgctaattattatgattgctatcttcctcaaaatgtttaaattgtggggtctggaccattaatacctgctaaatgaatgaaaatatttttttcccaaatagtacaaaaatttgattttgttgaatagtgaaaaataacatatagtaaaatataaaatataaaaattatatcttaaaatatgaatcttccatgctactaaaatgaaaattttaggcttataaaatttcagagcgtggtataaggttttaaatttgataaatacacacaaactattacatggctctaattatcttaagggagcacccacagggccaaagaatctggacaaaggaccaggacagtctctcaggctcccaacctggaaggaccacatgcttggggattaatgctctgcaatcaagtaagtgaagtctgatggtacaataagcactaatccagggcttgagagaattgggcaagactgccatggcctgtctgtcctctggactggacaatttgggcctggaggctggagggaggaggacctggcagctgcccaagggaaacaatgctaagtagcaaatctttaaaaacgtcgttacagagagagatcatggaagaaaggaaaaagtcgtatttcttattacatttagcaggacatcgtccctgctttctgaataagaggaccacattttccgtttgcattagacctggaaaattaagtagccaatcctaagtaaccaacagcatttgaccacagttttaaaaaatctaagaagaaattgtttttcaaagtgccagctattgatttactgggcgtcattctcataatcctaaaaacattaatctgtaccatgcacatttgcttaacatattcacatatttgtgatggggataggagagtcatctaagaggggaattagagaaagaaaaagtcagttctatactcatttgctgagtgaggaactaaaataaaatagcgatgctagccaccgcatgctttcaattaaacaacagtaaacatacaaagtacattatttcattcatttaaaaataagaatctgctcatcatccgatagaatctttatcagatcaaccagatccttaaatgatgtgaacattatgatctcacaatactaattcaggaataagctgtctcagtatttcccatagaatgtttcttggtatgttaaatgttttattataatttgattttctattacatttgaataatactgacaagacgccctatttgatggctattttctcctctgttcctgacttgagactccttggcaggcatgcttgagatttataggtgagattctcactatctgatgaactcttccactggagtgatatctaaggaatataaaaaagcatcctctacaaaacaaatgcaaacattagtctcctcatctaacaccgttaaataaagaggtgtagcatttgctatggataagtcttttaattgtattgcatgttttaaaattgcagctgaatataatataattttagtagctcatttctcctgaggcatcaacatcatttatcactcctgctgccatctggcgtgtctgaaccatcatgatcagcagtttatgtggaaattaaaacattcagtgggtcgctcttcaataatgctctgaggtcagggacaatattgctagcagcagtgaagatgcatttttattgcacacttgagaggcatccgtttgacgtactttatagctttctaggttaagactagccaagtttcccttatttgcaccgacctgacatgggggtcattccatataataactatctaaggatcattcagagtaattcccccttgctatcgtgcttatgcagctacattcagataaaagcgcagcagcagtaataaaagtcccattctctctctctctgattgcttgtttgttttctctgttaaagaattcagaaacagcaagaaaataccaaccacaggactaattaacatagtagtcctctaaacaaacatatctttgcaatattatttggtgatattgtcaaagataacttgtttgaatttaaattgaattcccgtgattgagaatgtgaaggacatattttagtccataagctaagttccacaattattgagcttctcagaatggtgagttacttaggtcaaatggactaaatgcccaagtaatgtaaatgcctaatcttttaaagtgttgcactacagaaatatcccaatctagaagaaactgtttctttgccatcaggaagattatgacttaacattttttaaacgataaaaaaatacagtaatgtcattccttccccagaaaatgaatgtttgccgaagtgaaaggaaaacgtgcaaatttcttctcttggttattcactcagtcttctggtttttattttatctgcccaacatcactacacaacatacacacttgtacatacacacacacacacacacacacagaacaccagtcccgttcatgaatacagtcagcagacattaaaacagagatgttaccatagaaaatatggaacctccatggaaacaatacccacatgtgctctgtatttaagaaccagtacttttgacagtactgagtttgttgtggtatatttcaacgtcaggaaaacttcagagaggaagtaagtctctataaaaaatgatggaaaaggagagatttgtatccattatatatgtactcatactcatcctaaaaaaactaataattcacaaagattctctcttatatttccttaaacttttatacattttatgtttagatctatagtcttcacaatttaactttcgtacaaggtttgaggtttagtttaaaggtttttgagtatttagctttggaagggtttttaaaattttcctcctaatgctcaaatgttccaacatgatttgttgaaaaggccctacctcctccattgaattaattttatggttttgtaattctgtcaaaagtcatttggccctactagtgtgactctctttcagaatagaatataagaatttctgttctgttccattgatctctgtatcgatcctccaccaaaatcagtcacacagcttttaatattgtacctttacagtaagtcctaaaataagattagtgtgactttttcagctttattcttctttttcaaaattgttttgacaattttagttcttccatttcccttcccttcctccctcctccgctcccctccccttcccttttttgttgcctaggctagagtgcagtaacatgatctctgctcactccaacctccgccttccgggttcgagtgattatcctgcctcagcctcccaagtagctgggactacaggcacctgccaccacaccaggctagttttttgtgtatttttactagagatggtgtttcaccatgttggccagactggtttggaactcctgacctcaagtgatctgcccacctcagcttcccaaagtgctgagattacaggcgtgagccaccatgcccggcctagttctttccgtttctatatacattttaaaaccaacttatatatatatatacatataatccagctaggacttttgataggaatattgttaaacttgtagataaatttggggagcattaatacttttactatgcggattttccaatccatgaatttgatatacctccatttatttaggtctttttaaaattataacattaccatagtttttagtatactgatcctgtacatgtttacagattagtatttaagtattttaaatttttggaccaattattaatggtattgtgtactttatttttactttctgttttttattgccataatagagaattttgattgaatttcatatattgatcttgtatctgtaatgttgttaaattcattaattagctctagaagatactttttcttatgtaaattctgctggattttctacatggacaatcaaattatctacacattgggacagggtcgttttctcttttccaatctgtatgtctttcatttcctctttttgccttactgaactggctagggttaccatcactgtgctgaatagaagaagtcaaagcagacattctttccttgtttccagttttaggggtaaagcatacaatcttacaccataaagaatgatgttatctgtgttttttttgtagatgttgaggataaagttgaaaatactaccttctgttgtttgttgagaatttttatcaggagcgacgtagagtttttccaaatatttcttctatattaattgtaatgatcattttttccttctttagactattattgaggtgaattatattaatttactttttaatctggaacaagttttgcattctctgaataaaccacacttagtcccaatgtattttgtatataatgcaatgtcgattttctaatatttttttgaaattttttgaaggtatcattatgaaggatatcgtcagtgtttttcttttttctttcttctttcatttttttttgtactgccttcgtctagttttgttataagagtaaaaatggctttataaaatgagttggaaagggtactactccctttttttatcttctggaagaaatttgttagaagtgatactaattattttgtaatatttggtaacattcaccagtaaaactatttgacactggagactatagaggaacttttaattactaacttaattttgttaataaatctaagactattccacttatctgttttatcgtggatgaattatagtagtttatcgttttcaaagaactgcttaatttcagttatatcatctgatttttatctgaaaatgtgatttgtagtattcccttgttatacttttagtgcttgtatgatctatagtgatatctcctttttcattcttgatattggtcatttttttactctcttttttttatttgtaagtataaatttttatagatttctcagagaatcagcttttagtttgactgatttttttcattgatttttctgtcttcatttcattaatgactgtcatgatttttattatcttttttattacatttactttgatgtattttgttagttttctagtttattgtggtggaagcttagagtattgagttgagaccttgttcctttctaacttaagtatttagcgcaataaatttttcctctagtgctcactttcacttagtcccatagatcttgatatgttgtactttcattatcattcagttcaataaatacatgttttactactctagagactccctgtttgacccaaaaatatttaaacatttattaatatccaggatgtcagagattttttttattacctttttgttatttcctttcagtttcaactctttatgattagagaacatattggtattgttttaattatttaaaatagttgaagtttattttatgactcatagtatggtctatcttgataaatgtctcctgcagttatgaagagaatatttattgtcttgttcttcagcagagtgttttataaatatttagaatccattggttgatgatgtttttcagtttttttatatttgtgttgaatttttgcctagtggctttaccaattactgaataaatggtgtggaagttcctaaccaaaattatacatttgtctatttattctttcaggtctatcagttgtgattctttatttatgtatttatttatttatttattttgatatggagtctcactctgtcacccaggctggagtgcagtgacatgacctcggctcactgcagcctccacctcccgggatcaagtgattctcctgcctcagcctcccaagtagctgggattacaggcacctgccaccatgcctggctaatattgtaattctagtagaaatgcagtttcaccatgttggttaggctggtcttaaaatcctggccttaggtgatccacccacctcggcctccaaagtgctgggattacaggcgtgagcctccgcacctggcttgcttcatttattttagagtggtatggtttggtgcatattaaagattgttatatcttcttggtgaattgactctcttatcaatatgtaacctcttttttcaccccgatgcttcttttgctctgaagtgtactttatctgatgtcaatattgccattccaactttttttcttagcgtttgtatagtatataatttttcatagcctttaacctttaaatctgaagtaaagttattttggccatcataaagttgtcatcatttttattctcttctgccaatctttgtcttttttattgatgggcttaggctttttacaaccaacataataattgatataatttgtctgccattttattatttgcttcctgtgtcttccccctttttttcttcttatttctcctttcttgtctttctgtgagttacatgaatgtgttttattcatgttaaacagtagtttagtactgagtatcgttttttatatttttaaaatggttattctagggattgcatatgcatgcatagtttatgtcaattcactagcatcaatgttttatcattttaagtaaaatgtaaccattatttagctccccatactggtccagtctgaaaagatcagattactgaaggaaagaaggaaagacaagacttagctcagaggcaccccagagatagttgaccccgtctatttagtgggggttgggatgaaagttaggttctgccaatggcctctgctgctgtagcacatgctagagtggagacagagcatggctattttcatggtgttgcctggagcagatgtagctaaaggttttctacccaactggcctaccaattttgttctcctttggctagagaaagcagtctttttgtgggattatttcttttatctactaacatttataagttgtggccttttctaacactcaggtcaaaatacatatgaggcaagaaaaaaattagagaattcactaccaggttaaccaaggtccctagtcaatctgccttattttcttcacttttcagagctctctggtgggtaacttatgtgtcttatcctaaaagttttgttgggattagcagaaggaataaaatggaatgcaccacattttgtctggaactgaaatttcatgctttgatcataatcttcaagtattatttcaaaattgcaagaaaattaatatggtagtttaaaatggatagacagttgatattaggttaaacagaggtaaaatatgggctactcagcattcaggcttttgagggactagtctcttcaagacggcagataggaggcagtgttatacctctcccacttggaaggacagaatagtgggcagagattcacactgtgaatatatttttcccaagaaccatcacaggaacttaccagaaaaactgaaagaacccacagaccctttgaaagaagtagcaggctacagtctacttcttaagataggcaaaaaactataagtttccagagtgtgaaggggtaaacctgcctctgagcacacattccccactgggaaatatgaaaatccagaccatgggagaagaactcaatcctacccaaagctggaactgatttagggagtggcaggaaatataaaagtagaagcagcagcatgaagtgccttgtaggcattcccagtctccagtgcaagaccagggaagccattcctgattctgtctcacaggagtccttgcagaaggcagccagtgaactcagggagaagttgcagagtgaaagaagcttccagctgaattttgtgatataatttcgagtggggacaaattttctttaatagaaccgtggggtaagcaggaagtactgcagatatgcacacaggagccaggcacctggccttatgagcaaatgggaaggtatatgatttgaaaaccatgcttgctatttgcatggaaccctgaggaaggtctgattcctgtctgctggctgcctggatctacacctggcacttttagctgagcactgaaggaacaagatcagccttgccaactgcatgggagccaggtgaggcttactgctgccggctactcttcaatccctttgtgaactcttgtgcacagcagagacagttatactgcctctgcaacattaccccagtggcgtgagaaccagcccttatctcccacagtggcctcccacatcagaccctgcccaaggagagtctgagctgagatccgcaaaactctgtccctacctggtggtatttctccacccaccctggtagcttaacacaaaggacataagcttttaggcgatttatggccccacccatcacctgagaaaccagaatacttcccatgggcaccttatggcaagctcatatcccactgctactactgcagctggtgctcttgcaaacaccacatcctggctggaaaccaaccaactcaggccattacagcacctctccatggaataacactgctcctaggaaggagagaacagctgtggtatcttagctaataccactgcctgcaacatcctggctagccagaggtcctgaatctgttcaggtgacaaattcactactagtataaccagcattcaagaaagccagcatactaagcctatctacaaccaagaactctcacagaatctacattactcccctgccacttccatcagagcaggtgccggtagccactgatgggagacttgaaaacggtcacatcactggatcccttgcagacattcccgagcaacagcctggagtttggtagacccattggatggctagacccagaagagcaataataatcactgcagttgtctctcaggaagtcccgttcctaggagaaaggggagagcaccacattcagggaacaccctgtgagacaaaagaatctgaatgacaggctttgagtcccagatctttccactggtgagatgtttcttacagcagaagcacaatcacagtgcacctctaccccaataggaaggcaacctctgggatcgtgaagagccttggagcaggagtccttgttccccccggtacaccactgcagacatacctggggtttctcccagctctcccagtctctgctatcttcaagaggtacacctcacaagtaaggacttacataaacttaaggtaaagaggtgaaaaaagatattccatgcaaatggactgaaagtgagcaggagtagttactcttatatcagataaaacagacttgaaagcaacaacagtaaaagaggcaaagaagaacattatataatggtaaaagggttagtccaacaggaaaatatcacaatcctaaaatataagcacctaacactggagctcccaaatatataaaacaattactactagacctaagaaatgagatagacgacaacacaatcataataggggacttcaatatccattaacagcactagacaggccatcaagtcagaatgtcaacaaagaagcaatggacttaaactatatcctagaacaaatgcacttaacagatatttgcagaacattcttccccaaaactgcagaacataaattcttctcaccagcacatggaagattctccaaggtagaccatatgataggctataaaaaaagtatcaataaatttaagaaactagaaatcatatcaagtatcctctcagaccacagtggaatatatatgaaaatcagcgacaaaggaaccttcaaaagtacacaaatacatagaaattaaataatctgcctttgaatgacctttaggttaacaataaaatcaaaatggaaattaaaaaatattatttgaactgaatgataatagtgacatcacttatcaaaacctcttggatacagcaaaagaagcgctaagaggaaatttcataacgttaaatgcctacatcaaaaagtctaaaacagcacaaagagacaacctaatatcatacctcaaggaactagagaaacaagaacaaacaatccaaatccagaagaaaagaagtaacaaaaatcagaacagaactaaatgaaattgaaacaacagcaacaacaacaaaatatatataaaagataaataaaagaaaaagctagttctttgaaaagattaacaaaattgatggatcattagtgaaattaaccaagaaaggaagagtgtagatacaaataagctcaattagaaataaatctggagacattacaagcaataccacagaaatacaaaagataattcaaggctactatgaacatcttcacatgcacaaactagaaaatgtagaggaaatggaaaaattcctggaaatatacaaccctcctagattaaatctgacaaaaaatagaaattctgaacagtccagtaaaatgtaacaagattgaaagagcaattaaacaattgccaacaaaaaagtccattaccagatggactcacaaccgaattatatcagacattcaaagaagaattggtaccagttttactgaaactattacaaaagatagataaagaggtaatcttccctaaattcctccctatatgaagccagtatcaccctaataccaaaagaaggaaaggacataacagcaacaacaacaacaaaaactacagagtaatatccctgatgaacatagatgcaaaaatcctcaacaaaatactggctaactgaatccaacagcattatgatcaagttggtttcataccagggatgcagaaatggcttaacataggcaagtcaataaatgtgatacatcccataaacagaattaaaaaaaaatcatatgatcatctcaacaggtgcagaaaaagcactggataaaattctagtactcctttatgataaaagccctcaacaaaacaggaatagtggaacttacctcaaaataataaatgccatatatggtaaatcccacagccaacatcatactaaatggggaaaagttgaaagctttatcattttaagtaaaatgtaaccattatttagctccctgagaactagaaaaagacaaggatgccattttcatcacttctattcaatatactactggaagacctggccagagcaaacagacaagagaaaaaacaaagagcatccaaactggaaaaagaggaagtcaaactgtcactattcactgatgatatgaacttatacctagaaaaccctaaagactcatcccaaaagctcctatatcagataaacaaattcagtaaagtctcaggatacaaaatcaatgtacacaaatcagtagcactgctatataccaacaatgaccaagttgagaataaaatcaagaactgagtctcttctataacaactgaaaaaaaaatacttaggaatatacttaaccaaggaggtgaaagatctctaaaagaaaaactacaaaataccactgaaaaaaaatcataaatgacagaaatgaatggaaacacatcctatgcccatgaatgggtagaaacaatgttgagaaaatgaccatactgccagaagcaatctacagattgaatacaattcctatcaaaatactaacatcattcttcaaagaactaggaatgatgtcagagtacgtgtagcagtaagtttttgaaaaccactaaattaacagtgagcaccttttagatgatcaaggcttgagaaagaataattgaacttttgagcttaagcctcttaggtggattgtgcaataccagtagaagtaccaattgagcagactgctatctgggtggcctctcagaagcctgaactcagactggcatgactgatacctagggtggaaatgattggaaagagattaaggatccctacaacttaagtgcttgaatacccaaaagacaaagctagagaagctgaatgttctaggtccaaacatcaaaccaggaaacgtcactagaaataattcagaagcaggacaaatgtagaaataaattctgaggcagagaggaagggaataaaaagaaggggcaccaaaggggaagtcggcacatctaccacacagagaaccttacaattgcctgtggtttatttggtatatggataaattggtttacttcagatgcttaaagtcatgatacaatttgtgcagttttgataaaacagtattacaaggaaagcacagccttccaagataggctttggttgattattttacatggaagaaaatccagaaaaatccctattcaaagttaaaatgcacatatagatgtacatacactctgaaaataaatattataaattttaaaaacagataatatgtttttgctcttctaagtgagtgcatgtttctttaaaaaactacacagaaaaaagacagtaaaagcacttacacagttgatagaaattttggaaactaattccctcaaatgatgactatattactgtagctaactttcaaagagtgaccttgttgaagaaaattgtcttttattgccattatcataattacacagtggtaatattttgtaaattttaattacagtgataaaaaatccttataattggggtgatttattttttattatttgaatgctattaagctttaacactatttcaagttttttatatactgatataaaatattccagaatatcagtatagcttcttttaactttattagctattaaaatgtttgagaattaattatataaaagctgtcaaaatgaaaattcttatgttttaagaatgcgacatatttcctattattaagacatatctcaaatctcttttctggaaagagttttgtgcacttgaatcagtgtactgttttcttttcttattcaaatgcatatttctacaaaagtggtgttaacactttatatattaagcaattttcaccagaaagctgacagaagcatgagacaacatattatctattaagatattgatctgttagagaattctagattgctattcctaaaatatttaactgaatagaacctttttcacatactataaagatgtttacaatgatatacttggactctattcaaatgtgatatcacacacagagtttctgatcaatgtttttaaggggcagtaccacaccatacaacctattagttattataccttaaaagtctatacatggtgcaaaaaaaatcaaaaaatcaaacgttactcttttgcctctgtggttgtctttcttttttccaatttgtcttttaattctctcataatcacacccattctgtaccgtaacacaaagactgtagtatagtctggcagatctcatttgaatctttactttctcctacttaccacaggcaatgacattgacaccacattaagagtttttactctttgtgtgttgggtttttgtttgtgtgttgggtttttgatttgtttgtctctttatccattcccagtaggcagattgagttggaatataattaatgtcataatatttaacaacagagggcagttttaaattggttccttaaaagaggggtgcctcacccccccaccccccacacaatgcagtgttcctaaagagccgccttactaaagtctcacagaatttaagtaagtctcaactgcgggagaagagtaagcaattgtaccctgacttacttaagcttctgatgctggtgggccagtcacgtcttctgacaggaaataaaaaaaaaaaaaagaaacccagagacagccgaagtgatacttgtgtacttaccttggacctgactggccatttaccatgaatggaggaacctggtctttactacacggcagagttaggtatgaatctaatcctagtatctgcaagtgatagcccagtagatcttggaaacacacatatgcacacacatacacacacacacacaaacacacacacgtatacttacttactctatggtaaagatggtaaaactgaggtgatgggggtggataatctcaacttgcattattaatcaattatgataaatattgaaagtaaaactttatgtttaatattcaatgaattattacactaaaggaaagacaatgtgagtggtcttttataagcttttacaaattgtacttttctatttatagttcacaattttgtaatgtctttttccttcttctcaattactcattacatctacaggttcctaggcaaaggctgaagtagaaccctgcattctctcccagcccttctcatcaacctcccattgcatcttaccaagaggagccccatgtgcctatgttgagcctctccctatatactgcctccgctacaaacagatacaactttggccctcctctaaccaagaaagaattgaaaacatttcactagcctactcttggggaaagagacagtggggaagaagcccatgtatgctctagaactggaactgggtaattatccatctaattaggaatttccaaggtcccatgcatctggaacatgatgtataggtggggctagctctaatggggacatctccttagcctcatggatttcacatcccatggagaaggacattgccacagtgggggtcatagtagagaatttaaaactcaagtgctacgtttaaaggccatactactcatgctgcaagaaagaaaaaataacttgtgtgtatgtgtgtgtgttaagtagcaataactgctttaaaataaaaatagtaatccaaaagtggtaggtaattcatcatttttggcacaagactttcctaaaaacagaccctgagacaaaaattttgggcaaataactgattaaatgattgcacttaggagaaattggtaaagaagcagaagaagaaagaaagagaccaacaataatgtgactttaggtgaaatcgtgctctttgcctagttgtatagggagctctggagcataaattccatcatagattttgttgtgccttgtggcagggagctgggatttcatgacccttcaccagttagcttttggcaatgggctatcctagagcctagcagacacatacacctctttaggaaaaactgccatagtagtcccagcataatttcttttagaatctccataaaagctagaaaatgggcctgtgaaggaagcctggagatctgggaggagcatagaacacagctctatagaagtgaagccaggatgcagttgacaaatgagattacagtaaaaagatgaggttcagatgagatttaaatgactgtgtccatcctcatcaccattgtcatcattattgtcatcagacttggtggaagcaaatgaagaattctgaaaaatataattatttaaccttttgactttttttttttttttgagacagagtctcactctgtcacccagtctaaagtacagtggcacagtctcagctcactgcaacctctgcctcccaggttcaagcaattcttctgcctcagcctcccgagtagctggaactacaggagtgcatcaccacgcctggcaaatttttgtatttttagtagagacgggatgtcaccatattggccaggctggtctggaactcctgaactcatgatctgccctcttcggtctctcaaagttctgggattacaggcgtgagccaccatgcccagcttgactcttttataataacacttagcttaaaacagaaacacattgcagagctgtacaaaaatattttctttcattatattcttattctataagcctttatctattttgttattttaactttttaagcttttttttgttaaaaactaagatacaaacacacatattagccgaggcttacacagtatcaggatcctcaatattactatcttcaacttccacatcttctcccactagaagttcttcaggggcaataacaggcatggaactgtcatctcctatgatagcaatgccttcttctggaatacctcctgaaggacctgcctcaggctgtttcatagttcatttatattttaataagtagaaggagcacactctaaattaacgataaaaacacagcatagtaaatattaggcgatgggaattttttagctccattgtagtcttatgggaccaccattctatatgccatccatcattgaccagaatggtgttacgcagcttatggctgtattttctatggccctttactttttagatatatttagtcaaaaaagaaaagcagcagataggagagaagtttatacaaaacataacaccaattgtagaatcttcaatgacagtttaaaatgccttagcaaggtgaaaacaatataataaacacagtatcttctgaactaataaaattggaactgagaaagcaaattaatgcacagtaatgaaattaaaatggggcatacttaaacttaaaaatagactctgctcttttagtactaaaaacaatacttatttataattactgcctaattcatgtgtcaccaattttaaggccatttttaatgtatttctatccttacgggatatacacttttttggcgtctatggtcactaagtccagatcctccaaagtccattcaaaagaaatgaagattcctttgtttaaattctatttttagtttagattcagggagtacatgtgcttgtttgttatatgagagtattacatgtgtaatagtggaggctgggtttctagtgtactcatcacccagatattggacattgtacccagaggtgatttttcaactcccctaccctacaccctttagagtcctgagagtctattttccttatctttatgtccatatgtaccctttgtttagttccacttataagtgagaatatgtgatatttgattttctgcttctgtattagtttacttataataatggccccctgctccacccatgtttctgaaaaggatatgattttattcttttttatggctgcgtagtgttccatcatgtatatataacatattttctttatccaatcaactttttgcagacacttaggttggttccatgagtttgctattgtgaatagtgtaataacatatgaatgccggtatctttttaatataacacctttttttttttttacctttggatagatacccagtaatgaaattactgggtcaaatgtattagttctatttttagctctcagaaatatctccatactgttttccatagagtttgatctaagttatattcccactgacagtgtatgattgctctctcttctccacatccatgtcaacatcttgttttttgactttttaataaaaaccattctgactggtgtaagatggtatctcagtgtggttttaatttgcatttctctgatgattcctgatattaagtattttttcaaatgtttgttggtcacttgtatttcttcttttgagaaacgtctgttcatgttctttgcccagtttatagtggttttttgtttgtttgtttgctgagttgattgaattctttttaaattctggatattaatccttgtcagatacataatttgtaaatattttctcccactctgtaggatgattattgtgccctgcagaagctttttactttaattaagtcccatttgtatatttttggttttgttgcaaacgttggaggtcttcatcataaattctgtgctaggctaatatccagaagagtttttcctaggttttctgctaggacatttgcagttttaggtctcatgtttaggtctttcatccaccttggtttaatttttgtatatggtgagagatagtggtccattttcattcttctgcatatggctagccagtttttccagcactattggtttaatagactgtcctttccccattgtttatttttctttactttactgaagattgattggttgtaggtttgtggctttggctttatctctgtgttctctgttgtgttcacttgatcggtgtatctatttttgtgccagtatcatactgttttagttagttatagccttataaagtaatttgaagtcaggtaatgtgatgcctgtagatttttttttccgtaggagtgctctggctagtcaggcattttgttattgttccatatgaactttagggttgtctttcctaacttagtgaaaaatgacattggtactttgataggaattgtgttgaatctgtggattgctacaggcagtatggtcattgattcttccatttcataagcatgagatattttttcatttatttgtgttgtctacaagtacttttatttgtatttggtagttgtcattatagagatctttcattgtcttctttaacatatatttctagattagtgtgtgtgtctgtgtggctattgtaaatgagattgagttcttaatttggttctcagcttaaatgttattgagatatataaatgctattgatttatgtattttgattttgtatcttggagactttactgaagtcactaatcaggtccaggagctgaatttcaccagacatacaaataaaagctggtgccagtcttactgaaactattccaaaaaatcaggaaagagggatctctccctaattcattctatgaatgctgtattaccctgataccaaaatcaggcaaggacacaacaaaaaagaaaattctagtccaatacccctaatgaacatagatacaaaaattctcagcaaaatactagtaaagcaaatccaaaagcacatcaaaaagataattcaccataatcaaataggctatattctagggatgcatggatggtttaacatacataaatcaataaacatgattcaccgaataaaaatatctaagaacaaaagaaagatgcagaaaaagcatttcctaaaatccagcaaactttcatgataaaaaccctcaacaaacaaggcataggtggagcatacctgaaaataatagaagccatatataagaaacccacagtcgaccttatactgaatggggaaagttgaaagcaattcccctgagaactggaacaaggcaaggatgcccatgttcaccactcttatttaacgtaaaactatctggcaatagaaagaaataaaagtcatctaaattggaaaaacagaagtcaaattatctctgttcactgatgacaagatcatatacctagaaaaatatttttttaagaggcaaatgtctattaacatcatattaagtattgtgcttagcatccagattctatttgcagccagggcattgtaaagattatttacctgctaaaatgtgtttataccagatcccattagaatctcaacggcccatcaagaatccccagatttccatcattatttgcctaaagaatgaatgtacacattgcacatattgagtataaaacattcctaagcagtttatgagcaaagtactgtattaatttcaagttgacagaatctgaaaacatgatatttcaaccacttgtcatttattattctccactctaatggctctgtcaaatggtgatctagatgttttttttgaatcgatgtggtcacaggagttttatctacctttgtagcggagctttcttcttaggtattataaagctctttttttagggacatctggtataatagtagagaccccattacacattgaaatactataaaacatttaataaggtaaaaacatccatactggtacattaaatgtatattacgactatgtaacaaaacacaataaggaactgtacaaaacatatatctaagtcatctggtcactatatcctgagtcaaatttatgattcaggctatgaatgagcaacaaggctcgtttaacagccgccaccttttcacgtgcagaagtctcctaacgaggaaagctgcattgtcccagaatacaggttacaagggaagaagagaggattggaacaatattacttttccctaattttcaggctttataattttctgtacaagcatagggaagcctggaggtcctttgccagggagaataagcttaatgttaagctataaaggaacatttacattagaaaagataatgcaggtgtccttatcacccgctttatgatgaagctcatggcaactgacaatttgtaaatttcaaatgccaagattctgcagctatcattaccagagaaggattaacatattttatggtaccaattttttaaaaaatcagtggatgtctcaaaatgctccaacctgaaacagatggttagcctctgggtcaattacccatggctgggttggtggtagtgaggatgagttctgagcacatggcagcctgcattctgcagcagaatggaccaaggagacatcacctaccaagcgggatgaaatcaccgtttctctcggttgagttaatgtctcttgaattttctttctgctcacatatttgtttgcttatcagtctacctcaagcaaccagagtgaatctttaaaaaacatgtcagagcatgtggatcctctgctcagaactttccaaggacactctcccaagccacagattaaagccaaagccaaggactttttcagcatctaccacaccttcacaatctggcttcctattccctccagacttcctttctcatgactctccttcaccacattctgtcctggttgcacttcctcaaacaaaccaggcaagtcaaggcctttcaaactacccttatctttgcctgtaatcctggagcctagctccaggtctctccctcaactcaaatcataccctttcattgaggctttctctgagcccatatttaaaattgtgaaaatcccaaatatcttacactcccttatcccttatcactttatttgttttcatagcaattaacaccttcttaaatgccctcagatttactgagaaggcagaatgtttgtctgtcttgttcacagctttgtctttagtgcctaaaacaatgcctgaaatataatgacatttccttaataaatacttgtgattgaataaaagttaactagtattatgataaaggtcagctatggacagtttaaatgattgttctccaaatctcactgttaataagtcttaaggatagggttcagaaatatattcctgtgaagcctgaaattttttactattaaaaaattagcatatgtgccaaagttcacaaagctttacgaatattcattcattttgccctcacaaaaagcatgagatgaagttactcctattatctctactttaaagagtaggaaagcaatcactagacatttagtaacctgactaagatcacaagctaataaataatctgtgctctgaactaatttctataagatcatgttaacatgacttgtttttataactgtgattttatattttctttagtatatatgcatgctttcagacattttatttttgaaattctaataagaacgtacgtatgcttgggccaacttcaatgtggagcgtgtgcagcagggctccttaccagccccgtaactcctgttgatatggtttgggtctgtgtctctgccaaaatctcatgtcaagttgtatccccatgttggaggtggggcctggtgagaagtgattggatcatgggggtagattcccccattgctgttgtgtgataatgagtgagttatcacgagatttggttgtttaaaagtgtgtatcacttccccctctctggtctactgtacaaaacccagacttttggccagagctcaggggaattcaggcatacctaactgtaagagaggctagtaaatgaaatttagctgcatgctcaagaagtagaggaaataggttttggtgccacacgtgtttcaagagagagcatgggaaagtgtctcaggcatagaattgagaaggctcctgctctggccgtgtaagaggcacctgcttctcccttaccttctgccatcattgtaagtttcctgaggcctccccatccgtgtttcctgtacagcctgtggaactgtgagccaattaaaccttttttatttttttaattttttttatttgagacggagtcttgctctgtcacccaggctggagtgcagtggcgcgatctgagctcaccgcaagctccgcctcccgggttcacgccattctcctgcctcagcctcccgagtagctgggactacaggcacctgccaccacgcctggctaattttttgtattcttagtagagacggggtttcaccgtggtcttgatctcctgacctcatgatccgcccgcctcggcctaccaaagtgctgggattacaggcgtgagccaccccacccagcctaaacctcttttctttataaatcatccagtttaaggtatttctttattgcagtgcgagaaaagactggtatacctgtacacctttgaactgccacatgacagttttctgttttgctctagttaatatatgacagatctcttcactagagcaccttcacatacacactaaaatataatgatgttataaaataattgtaggagaatggttaaataggttaagccacatgcctaagctataatagtagatagtaaaaaaatagttattacaattattaccatgctaaatgttaggttatgaaaattattataaaaaattaaatagataatataatcttacatgcatacatgtaaaaagaccacattgttataagaaaaagtactccaaatatatattatatatggaaattatattataatgtagcacagtattacattatagggttaatataattgattttgtttattctattttacttttagaggaaaaatcacttttgtttgttcatttatttgattcctttactgtattgaacacaaatatgcctccctttcgcatttgtactctatcccaggacacacagaagatgaatgctaattataaatgaggcaagtatgtgtgtgtgtataatttctctcccttggtctttacttatccaaactaaatcaaagttggttttacttttgtttaactggtagccaagagataaatacctaaagttcctttcaaataaaattgctgtaaagtggccaacaaacatatgaaaaaatattcaacatcactaatcattggagaactgcaaatcagaaccaaaatgagatactatctctcaccagtcgcactgactactattaaaaagtcaaaaaataacagatgttggtggagatacagagaaaagagaacacttacatattgctggtaggaatgtaaattagttcagcccctgtggaaagcagttgggagatttctcaaggaagtaaaaatacaactaccatttgacacaacaatcccattactgagtatatacccaaaggaaaataaatttttctatggaaaagacacttgtattcacatgtttatcacagcactattcacaatagcaaagacatggaatcaacctaggtgcccatcaacagtctatacaccatggaatactacacagccatataaaagaacgaaatcgtgtagcaagagggatgcagctggaggccattatctgcagtgagtaatgaagaaacagaataccaaatatttcatattctcacttacaagtgggagctaaacattggatacacatggacataaagatggaaaaagtagacactggggaatactcgagtggatagggagtgaggggagacagggctgagaaaatttctaccatgtactatgttcactatttgatgatgggatgaatagaagcctaaacttgagcatcacaaaatatacccttgtaatatacctgcacacgtaccaactgaatctaaaataaaattaaaagaagtagccagaagcaatggctcatgtgtataatcccaacattttgagagcctgaggcaggagaatcccttaaggccaagggttcaaaaccagcctgggcaacatagtaagaccccatctttaccaagaaaaaagaaaaaaaagtgctgggcctggtggcgtacacctgtactcccagtgacttcagagcctgaggcagtaagattgtttgagcccagaggtgcaaggctgcagtaagctgtgatccctaaccctactcctaacaaacagtaacccctaaccttagacaactacagtctgggcaactgaggaagaccctgtgtctaaaaaaataaaatgtaaaaaactcaaaaatttttttatagagagaaaaaagaaaaaagtaaaactgttgtaaagttttgaaggagtgtggataaataccatatatctagaattatgcaggaggttagtatacagctttgaaaaacttttgaattattttaagtagaatagatctgaggcattactttgttttgtactgaattgtgtacctgtagaaagaggctttaaacagttatggttaataaaatgccttctccgttatgttattacacgtaagacatttaattacatgacagaattatcaagtcccagattgaaagaagcataaggtctacatacggcctataaaccttgaggccattttcctcccattataattctggaggaaatagacactagttaatctgctaaattttgttcccacaatttctatgtctaaatctcaggttagaagtaaatgtattaaatttacttgttctaggcttatttggaagtaacaggaagtttgtgttgtattttatgtttaattttcctatgataaactattttatgttatagatgactagttaacttcctttcttagcttctaaactgtcatcaaaaattagatgagacctttgtgtttttgagtattagggagagaatactttcactcttttatttgtaattggtgaaaaacaagtttttctcaatttgcttatttagatgttacccaaaaaatgcacacaaaagatgataagaaacataaatttctcatctctattagaattaatccacgtatagttttgccaaaacctcagcagacactctgtggctatatgtgaaaccatcttctatgtgtctgctgcttaaatccaatcaggaaaatgagtaaccaccattcctttaaactagtttacacagtgggtggtcaaaatatcaccacattcccactgctcacctccaagttcaactccaggagtctctatatagtaacattaatgtctgaaattggattgagggattcccgtatgctgtcatctaaaacccattatgatggctataaagcaatggccactaaaattgatagaggaagatgaactgagaaaagagtttaataagtgaaaaacaagagttcttgagcttaaaagcaattttcacagtaggtctttgtatgcatctgcacagacatgaaactcaacaggagaaagtagaaagcctactatcttttcagggaattatctttgaaagaaaacctacagactggctggtcaatgtctttaaacaatttatgagaccccacaaatgcacaagaaggaagtgacctgtgaagaatgtgcaatccccaaaaagggcttattttccaacaccctcctgccatatagtcatgaaaaatttcagacgttaaagaaattccaagaaaacaaatttatcagtcaatgcaggcaagaaatgttcaccaagagagcagaatcaaggccttacacatggataaacacaggatcattatcaccggtgaaggtacccctcactcttcttgtcttggcgtagttccatcagaactctggacatgtgaaggctttgtgtttttcatgtatgcctctctgaatagaaaacattttctttcactgattttttcaccgtatttgtgcattgtatattgatacttcatggcagacttctctagacctgatggacagaaccaactataagtcgcccagatatactcaattttcagctggatgaagttacttgaaaaactttgattggttccctccaggaaagagttctgtatgtgagagaagaaacatgcatgtagccaaagaaacagtctgcactagagacttctactagtcctttgtagtagaattctccattttttaagcctgtaccatttccctgcatgtaaattacattatcaggttcctttgcagttacatgtggaaatatgattaagttctagccagtaagctgtaaagaacagcctgtgaaagttatttctaaagaaggagaatgtaccctttgtccctgtaattttctgctacctggattgcagatttaatcgccagggattgagcagtcatcttggaccataaggtgacatctagaaaaggaaagtagtaagctcaaaggagcccatggtatggtatctacccgattccttttatgataaataaacatatctcacccaagctatcattattgtggggttttcagtaggtggtaacctaactgaatcctatgtaaagcagtatgtctagtcccattctttacatatggaaaaaaaagcggtagtaacatttcccaaactatacagcctctaaaagctgatgtggaatttccttttttttaaaattttattattattatactttaagttttagggtacatgtgcacaatgtgcaggtttgttacatatgtatacatgtgccatgttggcatgctgcacccattaactcttcatttactcagctgactttagaaatttgtttcttaatccccaaaataaataagcattcactgaagatttacatgatatattttattccgctggttagaaattaatataagtaaacctaattttgtgaacatgaaccatccaagagcctgaatgagcatagatatatagatatatatgcttattttttataaacctataccatacacacacacacaccacacacacacacacacacacacacacacacacaggtcatgggagtggtaaggaaaatgattgctattttaaattttattcataatatttttaatgttaaattggaactaatatactataataaaatataataaattatgaattttaggtgacatatgatcagtagtaggcagtttattattccacttttttatgtcaatttttttaatgaaataatgaaaaataacagtaaaacagcataggttaaaaacaaaacagcaaattacatatgtgcctttgtgtaaacattttttcttaagtaatttaaaatacactttttttttttgagacagagtcttgccatgtctcccaggctagagtgcagtcacttgatcttggctcaatgcaactccacctcccgagttctagccattctcctgcctcagcctcctaagtagctgggactacaggtgtctgccaccatgcctggctaatttttgttgttgttgttgttgttgttgtatttttagtagagatagattttcaccacgttgaccaggctggtcttgaactcctgacctcaagtggtctgcccaccttggcctcccaaagtgctgggattacagacgtgaacctctgcacccggcctaaaatacacatttcctacttggtgatattttttgacaagataaatattgacttttataaccagcagtgttaattagctatttgatgtgaggtgtagaaacattcctccattgtgtcgaccgagtcatgaaagagtttccaacaacaaaaacactccttgggtttgaaggtcactggcttgttaccttctgaggtgaataatttctagaaaattcctttgttgctcttaataatgtaaactatttagattagcaaatgtttaaataagttaaatgttttcatacatttgagtagctttccttaaaaatatagcagtgctacttggcagagggtagtctgctaaaatagtcaaataattacaatgaaaagacgataaaaggagtacaacataaattaataaataaataccaagaagagattactgtaaagtagggatggttgtaacttttgtgggaaggggagattcaggatgaggacggtctcatggatggcttcgggagtcaaagttgtgtttcttgaccttgctatcaggaagtcagggagaagggtcattaaaaagctgttttttgtttgtttgtttttccatttggtaattaattaagctatatatttctttaggcggctttctgaatctgtatttcactttaaaacaaatagtcaataaatatgaatgcacaggcaagaagctaactagagtactcatttcctcttcccaccccagaaatagtgtcctatttagaaaaactttaaccacaacatgacgatcatatataatagtgcaactctctcatttctcctattttacagttagtgattcttgatgatttggttcagatttccacaccaaagcatcattgctctccatcatagcaccactagcagtatctgtcgaagcctgctaaggcaattggtattgagggacaggactagctggatttcctaggctgactaagaatccccaagcctagctgggaaggtgaccacatccacctttaaacagggggcttgcaacttagctcacacccaaccaatcaaagagctcactaaaatgctaattaggcaaaaacgggaggtaaagaaatagccaatcatgtatcgcctgagagcacagggggagggacaatgatcgggatataaacccaggcattcgagctggcaacgtctaccttctttgggtcccctccctttgtatgggagctctgttttcactctattaaaacttgcaactgcgctctcttctggtcagtgtttgttacggctcgagctgagctttcacttgctgtccaccactgctgtttgccgctgtcacagacccgccgctgacttccatccctctggatccggcagggtgtctgctgtgctcctgatccagcaaggtgcccattgccgctctcgatcaggctaaaggcttgccattgttcctgcatagctaagttcccgggttcgtcctaactgagctgaacactagtcactgggttccacggttctcttctgcgacccgcggcttctaatagagctataacactcatcacgtggcccaagattccattccttggaatccctgaggccaagaaccccaggtcagaacacgaggcttgctgccctcttggaagcagcccgccaccatcttgggagctctgggaacaaggacaccctggtaacagtatgagctcgaaaatgaacatcacacagcacagatttggagtccagaagtaaactggcaaaagtatatgaggaaattcaacaataccttaccaaggtattttttatttcacattggtgttaaaattgattaagataatgataattcaaatttattgactcaattatacaatctattttcttacttcctattgccagattattcttatgccttattaaattacgagcaaatatgattaacagtatgttcaaaccttggtcagactaaaacttaatttcggtaaccccaaatatttcaaatataaaactataaagtgagccataattttgttagttcagatttgtatacatgtttagtgttcatagtaaagatccaataaattttaaaaagttaaaattaatttgaatccactctattaatttttaaaacagtcgtttcatttggaaaagtactcagagaaatatttttgtgaactttatatgactgcatatgaattacttctgatctacttttagatgaaacttcttccttttgaagagtataaattattttctgaactagacatttaaatacaggaatataaaatgatccttcctcttgacatctgtttaatgtgcttacaaataatcaaactattgtattttagaaagtgttatctcaaaacttccaaaaatgtaaatggataagagtcattttaactgttgaatagtatagttgcatctctttgcaagcacatgtcctactaataaggcatatgggtaccagagtgtccagagaaatcagagtgaaatttcaacagcaccggacaagaactaaagcagattaatgcattcagactaatggtagagaagacccgagtgaccaccattgcagctgacgtatatgaaagcttttaaaatttcatttcttgttagtttgatctctctacattaaaaaggatgtgctgggaggcagtttaaaatgaaaaggttcatttatctctgggctagaaagttagagttacccaattttacctcttaaagaaaggaaagtgagaaaaattgatcgatggtggatcaggctcaaggaatcttagaaatgtgtctaaaattgacttgttccagatcttctcacagatgaaactgacactttgcctttcactaaaaaccttcaggaattgaggtctaaaacaatacaaccacactaagatgtcattagctgattagatcttaatgagttattttttcacattgagctcatattatggtcagaaatattcttcctcagggaactaatatcagatgctagaatgataaataaatttgcccatttttagaattttctcctttctataggttttcgggaaacaggtggtattcggtcacatgtgtaagttctttggtggggatttgtgagattttggtgcatccttcacctgagcagtgtacattgaaccaaatttgtagtcttttgtttttcttgtcccttaaattatcttctatataaacctatagccaaaattgggaaggtgagacgtgaatgttctagctccttcatctatttccacggtattttactggaatattttcttccacttatctctaaaatatacagcactgccacatccagaaatactttatcccatgaaaactgctttctttccataatttcaaatattctttagcctccttctatcctgaatcttgccaaatatctcctaatgctttcaaatccaaattccccaaaggtatttgatgggaaaaagatcactacttaaagatttgcaaatgtattaaatagcatatctataaatatgatttcaggacaaaatagaaagaaaacatgattttaatctaagaaaaataatgggccaggcgcggtggctcacgcctgtaatcccagcactttgggaggccaaagtggggacagagtgagactttgtcaaaaaaaaaaaggaaaaaaagtcttatagcaaaagcaaagtgtgtgtgtgtgtgtgtgtgtgtgtgtgtgtgtgtgtgtttatttggaagatgaaagagacagttgacacagttttactacccaaatatgcatacctattttactgaatcaagaaacatgaagtcctcctaaaaggaaataatttaacatgggtcttatctaacctccatttttttttctttttggtctctgacagcaagagcgttggaatcctatctaatatttcatagatgtctcagagttacttgagcaacaatagtttttaaaatcaagatctaagctttaatgagcaaaatgttatgaaaaaataaaatataaatacgttttcatgtggtttatgggaaataggctacgataaacattacaaaacctttttctttattatttttagaaacaatcttacaaaaactttcaagtataatataaagaagtttttctaaactatttgagagtaagttgtagacatgatgctccatcacactgagcaaacaagaatatgctgtccaactacagcaaaagcatgaagaccaggcgattaacatagaaatattaccatcatctaatcctgctaatcctcaggtcctcaaatttcaccatttgtctactgatgtccattttagcaaaagaatcaagttcagagtcacatgtcattccaatctccttttgtctgaaacagttcctcaacatttccttggctatcatgaccttgacaatcttgagggtttcaggcgggtacaagtagaatgccatttagttttgttttgtctattgtttccttatgattgattcaggttatttatctttagcagaaatatcatagatgtttctatgttcatgcggtggctcacacctgtaaccccagcactttgggaggctgaggcgggcagatcacctgaggtcaggagtttgagaccagccttgccaacatgacaaaacctcatctctactaaaaatacaaaaattagctgggtgtggtggttcatgcccggctacttgggaggctgaggcaggagaatggcttgaacccggaaggtggaaagttgcaatgagccaaggttgtgccactgcactccagcctgggtgacagagtgaggctgtctcaaaatatatatatatatatatatatgtctttatggtagaacaacttattttcttttgggtatatatgcagtaatgggattgctaggtcaaatggtagttccactttaagtcctttgaaaaatctccagactgctttccacagtggctgaactaatttacattcccaccagcagtgtataagcctttccttttctcctcaacttcaccagcatctgttcttttttgactttttagtattagctattctgactggtttgaatggtgtctcattgtggttttgatttgcgtttccctaatgattagtgatattgaacattttttcatacacttgttggccacgtgatgtcttcttttgagaagtgtctgttcctgtcctttgcccatttttaaatggggttgtttgtttttcgcttgttgagttccttatagcttctgaatattagacctttgtcagatgcacagtttacaagtattttctcccattctgtaggttatctgtttactctgttgatactttcttttgctgtgcaaaagctggttactttaattaggtctcactggtccatctttgttttggttgcagctgctttaggagtcttcatcatcaagtctttgccaagctgagatgtccagaattgtatagcctagatattctgctagaatctttttccttttaggttttacttttaaatctttaatccaccatgagtttctttttgttttttgtgtaaagtaagggctcagttttcaatattctgcatatggctaaccagctatcccagcagcatttattgaatagggagttctttccccattgcttgtttttggtgatgctgtcaaatatcagatggttgtaggtgtgcagctttatttctgggttatctaatctgttccattggtctctgtccgtttttgtaccagtactgtgctgttttagttactatagtctagtagtataggttgaagttgggttgtgtgatgcctccagctttgttcttttggcttaggattgctttggctattcaggctcttttttggttccaaatgaattttagaatgacttttttctaattatgtgaaaaaatgtcataggaagtttgatagaaatagcattgaatctgtaaatagctttgaggagtacggccagtttaacaatattgattcttcctacccatgaatatggaatttttttgagttgtttgtgttttctttgatttttttcagcagtgctttataattctcattgtagaggtctttcaactccttagttagctgtattcagaggcattttaaggcattgaagggacatacatcaaaatagtaagagccatctacaacaaacccatagccatcatcatactgaatgggcaaaagatagaagcattccccttgagaaccataacaagacaatgatgcccactctcaccactcctattcaacataatactggaagtcctagccagagcaatcagaaaaaagaaagaaagaaaaggtatccaaataggaagcgaggaagtcaaaatatctctcttcacaggcaatataatactatactagaaaaccccatagtctgtgcccaagggctcctagatctgataaacaacttcagcaaagtttcaggatacaaaatcaatgtgcaaaaatcagtagcgtttttatccaccaataacgtccaagctgagagcaaaattaaacatttaatcccatttacaatagccaccaaagaataaaacactttttaatgtgaaactaaaaaaaaaagattatagctacaggtataaggtaaataagcaattaaaatgataagagcatattaggccaaactccagttatatatttgagattgttaatatgattgatgatattttgaaaaattactgcaaaaattgatctccctaaagtagaattgattataccatttctgaagaaaattgagaaagttacaaatattatcaatgtgtcttccatacattccctaaaggtgtcatgaatatatatatacatactttccaacatccataaaattctgtaagctaaataaaatcttaatttagagaaactttctatattttatttctaaatttctatatccaatactaaaattcccccaaagataatagttgggaaaaaatatgtaccactacttaaatatttgcaactgtattaaatagcatgcccatacatataattttagccttaactacaaattagcagaaaagcatgatttcattctgaggaaaataatgtatgcttgttgcctgtatgtatgtgttgtttgtgtgactcaagctgaaacaagccctaatgactccatcattaactcagagagctaagcagactgggggaagaaattgggaaaatagaaataagggaaagtccagagctccctatcatttgattgaactgagtttccattggcagaacagtgttcttgatagggccacatatatcagaatatcaagtagtgtaataatagaggcttgcatagattcaaagccttagcagacactttagttccaataatttgatagtcaattaaaaataataatttactattgtgtgaaatattataatggagactagtgcaggtatctaaatcatctcaattactgttcattatataatttaatgcaagacagctgggcgtagtggcaagtacctgtaatcccagctacttgagagccagaggtgggaggattgcttgagatcagtagtttaagagcaacctgggcagcacaacgagaccccatctctgaaaacaaaagtaaaagtgaattagctgggcatggtggagtgtctgtagtcccagctactcaggaagctgaggcaggaggattgcttgagcccaggagtttaaggctgcagtgagctatagtcgcaccactgtgctccagcctgtgtgaaagagcaagacctcaagtataaataataaataaaaacaataatagtaatttaatgtaagaaaaatggtaatttgttctttacaagaatgggaaattaggcaagcattgacataagtcagttgataacattctgctctgttgcttaaacaaaggagttccagtgttgaaagagcagaatggtaagaaacataaggaaaaactggagatagtaaaatctgagacctctaagaaaatgataaattattctaaaaatatgtgtttgtgtagatttcatatctgcatttaaatgtattgaacattttagatgtttattcttgaaattgaagcttaaagattctgtgccatggtggtaacaattttccaggtttttctataatatttcttgttgttgctttactaatttgaagaaattctttaaaacggtgacttgaaacttctgttgcttcactcacatgaagcaaagactttgcggcagtctatcatcttttgacttgcttataatggatattaatatcctaaaatttcttacattcatgcagcctatcctgtcatttttttcctttatgacaggtttcctgtcttgcttaaaaatgactcataaatgttgaggctgctgctcatatttttgtttctatatttaacacattaatctctttggaaatcattccatatagttgataaggcaagctttatttttctaagtggaaagcctattaagcaaacattattaatttaaaaaacaatcttaaccactgcattgaaatatccctttaatatatgttatattccccatattcttagatatgctctgagatcatgtaaattatctttttaattttttatttatcctataacataattttaattatagcagattaatatctttttattatattgaatcacaagctcttgatcctagaattctattataaagttatattgaagtatctcacctttattctgccataaaaacttacaaaacattttaatgctttccaatatggaattctgattgattttgaattaaataaagatttacaataaattttgcaatgtggaaaaacaaaaagttaagttttaaaattctggaacattataagcctctccattatttaacttaaaacattatttttcattattattttttatttttgagacggagtctcagtctgttacccaggctggagtgcagtggcaccatctcagctcactacaacctccgcctctcagtttcaagcaattctcctgcttcagcctcccttgagtagctgagattacaggcacccgccaccactctccagctaatttttgtgtttttagtacagatgggcttccaccatattggccccaaactcttgacctcagatgatccacccacctcgatctcccaaagtgctgggattgcaggcgtgagccaccactcccggcaaaacatttttaacataactctttaaaaagaatgaatttaggtatccaaaaattagctaggcatgccaatttgtgtgagaaacacatcagatgttaattgtttgggatatttaacatttgaataggaattaattgtactaaattttgtgtatcaattgaaatgtcagactttcatgatgaatgattaaaactaaaggcacaagtgaaaagtcagattccaattcaaatgtgaacatgaatagaattctgcaggtttttattatatatttaatacctaattgattagttctcattttctttgacagtgagattgaatgaattaaattatggtcaatgttatcaatgaatgcattcatcttaacctttttttagtcaattaccactataagcactattcttttctcttttttttctatatccaaatttgaattaaaagtgtacagagtcaaatgtacttagtgttaaatggtagaaagataacaagtatgaaaaagtataaatcataaaagtagcaattattatagaatccagcactctagtatgtgacatttaagcatctctctcaagacttcatcatgaacaatttatagccttaactacaaatgaaatgtcataaataattggtcatgtacctttgacatttcatctcagatttggtgaatcaatttgtaatctggaacatttgaagccaatatctggggtctgaaatctcaagggtagttatttttaattattttatggaatgtatatattttgctcatttctttaaacataataaaacaaatccttgactaaagaaaaagaacaaaagttgtaataaagaaagctgccaaacatcctaaaggaactattaacaatattaataattatagaggtcatttaattttttctattaagtgaattaaacttaatatgtcattttgtacttccgaggcttagggggaaaagctttgcatattcctgaagaattttcattacctatagaatattaatttccacttacggttcagttccaagttacagtgagatagtgctgtctcttccaaactttggtatccattaactctcttttgtgactgtccttaaataggccaagtaaacttagctgaagaaggaagcaaagatattaacaacgcaccaaagcatcttgctgagtcaaagtccaaggggataagaagtctcaagttaggactctggaaaaattggaatcaaggaacggatcactatcagaattccctttccaacttcctgctttctatctctccgtttaactcactgtactttcatgtagccaatcatatttatttatttccaatacttgaatcagaatatgatagtcaagagtgtacatgtttacatttcattacttaaaaatagataacaagttgagttgaaattttagtaggatccaaactaaggaaccttcctaatcagactgagaaggattctgattggctcagctgaagaatgctggcacttcaaccaattcataaggaaggaggcagctgtggggacatatttcccaaaacaatagtggaggtgattctctgaaaatgagatggaggacaaatgaagctaggaacaaaaaataagaaagagtgggcaatatattttcttttctttttcattcctttcctattctaggaatatactgtcctatgatttaagattgtcaattttacaaatccaaggaggaaccattattagagaggatatatgaaaagaaaacaaactaaaacctctttgatatgcctaaataattttctggtaaattgagctgcttttctctcaagtttaagaaacagcgtttagagttacagagggtggctggaaatcaatagctcagagaccttgataaatgaaatcaggaaaatgaaaacctcaaaagggtcaaaagtgaacattcttgaccttaagtggaaaatacgtctgtattttctaaccacatcaaatctgttcacctacatattactattttaccacgtcgtttatgaccacaaagcatgcatcctggatcttgctccataattcatcactgtcttgctagctctttgatacttcctggtaagtttaaatatatattcagtctagtttttcagttttactcaatgagagagagtaagagggagtttgcaagagaacaagaaagtgaaagagagagagagagagactgtgtgtgtgcacgcaaaaccacctttgcaaaattatgacagtaagagaaatctgacatgtttggctccatcttatttctgacctccaagctgttctcggtcattcctgggtttggccatgctagctttgggaggaatttagttcatagtttaacttgaaagcaaggatgataatagtccctccctaaaatgaactccctctttgctcaggaaacaaaaactgcccttgtaagattaatgaaaggccataagaataggattatgcgacaggcctgaattctgctaaaatgtagcaatagtttctataatcctctgcttctcaggagttatctagctagaggtcacaagacttgtgactttctcaattgttcctactgataacatcactattgtagaatctaagatttcttttttgttgttgttttttgagatatttttcagactgaccctgcctgaacccatgactcatgacccaactggtcctgtggtcctacccagaagtggattcagtgcagagggccacttcccacaaccctatgatttcatccccaaccaatcaacaacacccattcctagccccctacccaccaaattgttcataaaatccctaagctctgagcctgtgcagaggcagatttcagtaataactccttctcccacatggccagcttcctgtcagtcaaactctttctctactgcaatgccatggtgtcagttaattgattttgcctgtgcagcaaacaacctatcaggtgactacaagagcagaatcgcctactctaccatcatcaaatgctacttgtcaattggttttagtgctcacggtgattcataccataattcacctagtaattataaaatgattcatataacatttagtatttgaaactttaaagaacctagtaagacaccaactatatgtttctatcaatgtggctgaaagaaaagagcaagctgtattgtgggagaagtgtgccccttcactgttcacacagcttggggacactgtttttaaaatatctagagttggtatggctgaaataccgtttatagtctctcttcctatctttcacacatgctacctctatccttttacaccactttcttcctttctctttttcacttccttgcttatttttgaagaaatcattaggtcaatctccagtttcacctaaatgacagtatcagtcatcttgagcaggccagaaaataatattgtcatcttccatgtgtcctaccaaatgtaatgcctttagcatctgctttgaggtttgacagaaaaataaaataaaaataaagtaaaataaaaacacacacacagaagattccctcttccaaactctctgaactacaatgaaagcttgtctcagtccaaattctgccatactcataaacatataagaggcacaaaatatggggcccaggttctggagccagctggtttgtgtgcaaaacctgactcagtcaattattatatgtgtgacctttggaaattcactaaggttccctgggtcttagtttcttcaactatgattatcatgcctaccttgagttatggtgaaggcaaatgagttgatatatgtaaagcctttagcacaatgcctggaagacagtgagcactcaataaatgctgatcatttctataagaggtactataggttgaaggctaaggacccaggctctggagtcagctgtcaggccccgaagcctagtctgcctctcaagtagctgcatagccttaggcaaattatttagtaggtcaaactgttttcagatcccaaattattgttttttgtaatccttaggggtcaacaagaactgcaagagacttttccactatgtacataaagacagaactggcccaccaaggagaacaaatattcctgttccccttcctgttatctcattatcctttacaggaaccacagatgaacagaccgtttttcaagatagtgagtgtctccaattatttaaaatccaaagaacattatttacaatcaatttaggttctagatcctatctttctccctagtaatcatttattgcccctcaatggaattcttcgtagtccttctcccacaacttgttttacaacgatccaagtgcccattctttctgtaacctcaagatgatacataagctcctgtacctcattgggaagttgcgtcttcattctgatggctcctgtgtaaacatgttaatttgtatgccttttcttcggttttttaaaaaagttcaaataatatccaaaaagttagccatcacagttatacatttaataaatccttccttgtctttattccacctttaaacttcctaaattaccttggttttcttctccgaaagttttaattactttcctttatagttaaggttttcaaattttgtggttacatactttggtggtgtaaggtacatggatgtgctttggtcaagcaataggcggaggcagatatccaggccttcatgacttatcgagtttggcacgcaggtgcacacctccacttgttatataacctctatgagtttataattggctctgagccactgttgtttgtaaaaggtgtaattgccctgctaacgctgtacaggggctcttggggctcagctgggctcagcatggcttgacatgttgggctcgctggtgcccagagagagagaaccagagctgtccatcttgcagacggacataggggagccacagcatggctcacgctggtgcccagagagaaaagagttaagctgctgacccagaaggcaagggagagctggccatgcagctgtaggtgtgggggtggcaggagccacagagccagagcaaacagctgagacaaaggtggacaatgtgaaaagagctaatgagaaagctgataatgaaagctgctgctaaataaaaaccatattcacctgcctacagccctccgcgtgttctttctgaccatccacccactcccctcaaacttcagcataggctggacctggaccccgggatctaacaggtgggtttatttgtcattcattaacaggtcactaactgggctcttccagtgaggggattcctatactgaaactcaaaaaatttcttccttttggtggtaggaagagtggataatttccagaattttattatgtaaaccaagaataaaattctaagtgcctcgaccaactgaatggacctccctcttgggcaagaggacccaaagaaacctgaaaaactagttcaggccatgacagaaatggaggccaggcatatctcattacaccctcctctcttaggagttcaggcacatctgaccagcactaacattgaaatagagctcttcagactgacaaaacagattctttgtagcaataagctagcaaatttcaacctgactctagtagagcatcacatgacagcaggccctgaaggaaatcaaagtatttacaccaaaatatatttctttgacctattttggaatgactctgcacagctgtctcttgtgggggaactttgcattctgttgagaatctccttcacttactagctcacttctggaaaggctggcaccctttaaatatctgaataggaaacatttgctctaaatagaaaactttgctcccctgagctctgaacctttggggaggcagatttgagtgatagctccatctcccacatggccagcttcctgtcaattaaactctttctctaccacaatgccatggtctcagttaactgattttgcctgtgcagtgggcacaaagaacctatcaggtgattacaagagcagaatcacctgctctaccatcatcaaatgctacttgtcaattggtcttagtgctcatgatgattcatatcataattcacattgtaatacataaaatgattcatataacatttagtacttgaaactttagtacttgaaactgagtggccacctgtgagatttcatctgtataacaaaaatgttgttctccacaaccccttatcttaacccagacactacttcctattgattccaggtctttagataataacttaactctttcaaccaatcagaaaatctttgaatccccctacaaactggaagcccccacttcaagttgtcctgcctttccagactgaactcacatgtactgattgatatcgtatgtcttcctaaaacatataaaaccaaactgtaacctcacgaagtcagtagatccagaccatcctggctaacatgatgaaaccccgtctctattaaaaatataaaaattagccggcttggtgacgggcgcctgtagttccagctactcgggatgctgaggcagcagaatggcgtgaacctgggaggtggagcttgcagtgagctgagattgtgccactgcactccagcctgggcgacacagcgagactccgtcgcaaaaaaaaaaaaaaaaaaaaaaaaaaaaaaaaaatatatatatatatatatatatatatataaaatatatatatatatatatatataaaatacatatatatataatctaaccaccttgggcatatgttctgaggacctcttgagactttgccttgggccttggtcactcatatttggctcagaataaacctctttaaatatttcagagtttgactgtttttatcaactgctgaattaaaaagtcacaaatctataaatttagaaaaaagggttttatttctaaaagtgggtatcatagcctgaaggcaggaagagaagcctccaactgaaaccgaaaagcaagcgcttcaagggaggggcaaagggaacaggaatttaaactgagtgaggtagctaagtttacatattcaacagattataggaggtactatgaatattcacagggggtggcgtgcacatgcatagtaggctaacatgtacgcaatatgcatcccatgttcaccttggggacagagacttaacatttaaatgtattactattaggctgtttacttgtaaagccctttgggtgcagtctctgtgctctgtgaactgactgccagaaccacttcctggccagtggtctcttacagggaagaaatactgatcagttgttgtgcccaaccacagaaagggaaaggcagggtcagtgcccaaccaagaaagcctggttgatattcgtagtggaatctttttcaaggggttggtttctgtttagcccttaggtgaaaaaacaaaactaataatggcagttaatgagagaggagtacaacgaggcgtattcaacccttcctcctgtgggggctggaactcagtattttttcttggccaggtggggtatccaagggctccccttggacaaaagatggtctgttcagttgattgggggcttagaattttatttttatgtatcatattttatctttcttgagctcattttatttagatatttggcatcatttatcaatactgtttgtctcttatctttcacattttcttgtttctctgattttatttggtgttttgggaacattctgtgattatgttttctaaactccctggcaatcttttaattttattttagacacttatttataattttctggatctttggtttattacctgatttttcttttttatttaaaaaatggatgccatatctcttaaatttctctgggcatacacattagaatgtctttttgtattttgcttttgttctacattcttttttgtcacttgtattgcttgtgttctggggcaatttttcattgtgatggcttaagatgttgagagaatattttgttctccattcatatctaagaatgaggaaataaaatgctggttggcagctctgggtatgctactgtgctcatttcttgttcatctttgcattagtggagtagaactagaagccagggttaagaaggaaggccaggctgggcacggtggctcacgcctgtaatcccagcactttgggagtccaaggcaggccgatcatgaggtcaagagatcaagaccatcctggctaacagggtgaaaccccgtctctactaaaaataaaaaaatacaaaaaaattagccggacatggtggcgggcgcctttagtccctgctactctggaggctgaggcaggagaatggcgtgaacgcaggaggcggagcttccagtgagccgagatcgcgccactgcactcactccaacctgggtgacacagcaagattctgtctcaaaaaaaaaaaaaaaaaaaaaaaaaaaaagaaggaaggccaaagccagtactcatcaccttcccctgggacctgcacattctcctagatgaacccttaagataccagcttgggggcttgggggctacagctgggataccatgtggtgtgtgaatctcagagacaggaaagtaaactctcttatgaaaagtttcagttaatccctttgaatttagctccatgttttatttctcctcagtcatactttgcattcttgagtgtttagattctagatttctgcaggtaaaatcagcttctttctgagctgcctcacactttagaaacattctaggctacttctttgactgcctggcacagtactcactacttttaagtccaattaccgcgatccaaaattaaattgaaattgcttatgtggtcttttgcctgatagttttgttcatcagaagtttatacctttcagtggcttcctgttattttattggcattttaaaagagaaaaacaattggtggtgatcaattcattttatttacccaggccatctaaactatgggtaggacatttccctatgccagagactttaggacctttaaaaggctgaccagactatttcccacgcactataatagttgttccagtatgaatcttttaaaaattgcatcaattataaaaacatttgcattatcccatcaaatgcgacaaaaaaattgtgattaaatgcatttgtctttcttatatactactacttcaaatagcaaagtaggaatgagatttcttaatgcctatctcatctccatcttttgtaaatatgagatagtatgcatttttttccaaaagtttttaagataaattaaacaatgcaaggaaacatccagcttaagatttagtacactgtaagcctctaacaaatgtctattctctagccatctattacaatcccaactagagaaacagatttatatttattaagactttgaaataaaggtttatgtttaacagatgtctggtagctgcaattctgaaatagtcagctgtctctaacttcatccaaatatgagataatttgagaataatttaaacagccagggcgttaggatcctttgagataatattgcacctcacaggctggttttactgacttactatatgcagaggttgtctgccaagtgcatgactttgatgcgacagaatgtccacacatgtcagacaaagatttattactcaaggacaggcagcacagataactggaagtgtagaacccatggtgagctggtctcccaagaaagctgccgagggaatagaatcccactgggtgcttcccatgttgcacggcagctgagggacactgaaagcactccagccaactgtaaggtgccaccgggctcactaagtgcaagcgccatagaacatcttattctaagaaaatgaggacacagcccaggttgttccggacagttcttccttgtttcagcatgttgcactctcagtacattctgactgagaaatgcaagcaagagagggaagatttgggttagctaagtacatccaactggggacttttcctcctgggatatcattagaaagctatgcaccccacccgactgtgaaaatctattggtcattgtctataatggaattcattgattaaaaacaagttttatcttcaacacattttgcaatgtattttaaaataataaatcggcaatacacaatttacacatgtatgcagtgtgtaaagactataattacttagtaatattattttcaagtcttcatataaaagaaaataaaaatagaaactttaattcaaaagttgaataattaaatctgtaatatacttttatttgttttctgtcttttatgaggaatcaaaacaagttttggcttgttgtactacttgaatgagaaaatattattaaaatgagtgcaatcataaaactgttctcaaaattatagaaacacaagcaggtaaggaacactattccggaaggcaaaaaatggatatagcaagcaataagagttttaattattagtatttctctaagaagagatcatggattatcaccaagaaactaaaacaaatgaaatacattgcgtgcaatgaaatatcaatttctgatgtttgcctactgcttaagaaaggtattagaataaaacaaactgatgtatatcacaaaagagaaatagtttatttattgttatgttttctttatttgtattttttgttttagtaattttatactgtagaagtgcttttgaggatatctttttttttctttacgaagtaattaaacttatctattgtacagcatggtgaatattgttaataatagagtacatttcaaaattgctaacagaataaatttcaaatgttctcaccacaaaaaaatgataagtattttaggttatgaatatattaattagcttgatttaattatttcatgttgtagtcataaatcatattactttgtaatccatcaatatataaaaatataaattgtcaatgtgtaataaaattttcttaaaaaagtttttaaacctgcttaaaaaaataagtgattaaacttgtttaagctctatcctctttctcgtgatccaccatcatctcaggaaaagagatttaaaagctgtatatgaaaataaagcacaaaaaagcaaaaggaaatgcaaaatgaataaatataaaaacatgttgattgaagagaattttaaaagagaaagaaaaattctaatagaattatataataaagcagtgatgagataaataaaataacaaataatttataaatctattcctctactaaaatgtacatataaaatccttatctaggtgcagttatgttttttaaatataacaataaaaataatgtttgtgcacagaatttagtaagatatatgccattcaaaaccaacagtagactatgatgctttatatgatttccatttctcttaagaagttaaacattataggctgggctcatgcctgtagtaccagcactttgggaagccaaggctggcagatcacttgagtttgagactagcctggtcaacacagcagaactcctcctctactaaaaatacacaaattagctgggcatggtggcacatgcctggaatcccagctatctgggaggctcagggtctcaggcaggaggactgcttgaacccaggaggcgtaggcaactgtgagctgagacggtgccactgcattccagcccgggcgacagagtgaaactctatctcaaaaaaagaaaagaagaaaaataaagaagttaaacactgaagagtcttctaagtatttagaaacggccaattcaaaagtgctgataatttctaacttcagcctctgggattccctgttcaggttgagctgtataaagatgcatgtatatttttttgccagctgctcttcaaatgataagtgatgccttttaattacattttacatggtaattaatttaaaatacccatggaaattcttcatcttggaatccctcttcaggcagcgcccagatgccccaggctttcagcactttactccagtttccaaaatattcttaaagtacctaaggtaatagagagttttgaaaatattccaagcagctagaaaataaaaacagccatttgccgaatgaacaataaaagagcaacacatatgtttacacttttgaaataaagtaatacttttcattataaacacatgcaaatagaacacaaagaaatagtacaatttttgagttatctgaatatttagctattttacagcagcctcaatacaagaaagccatcatcttcagtagatgctttgattccacagggccgtaactgtaattttcattttgggccagagaattttttctaaagaaagcatacttttatttatttacaatttaaataattacatcataattttacttcctatttgtattttattgcacattttaatctgctgccattttgttgacattaatctgaaagaaggacaagattgccaaatctgaatgcattatattgatcgtgcatcttatcagttcacagagcaactccgggtgaggtcggtgagagcaacttgccttggcagggacaagtacattatcactggcattgctgtaagtcctgacacatagtaataataacagcagatcaacttttattctgttttattattgatgttgaagtctctgcaggtagtgccttctcttattttttgcatctaagtttctgggattttctgcatccttactgccctgctgtcagcgaaaaccaaactatttaataatattaataataaagtttgcacatgtcaaaagcaagctttgacttcacactaaatccaaaatgagaaaaatctttttctctagggagaaaacattttccctgcagaagtccatatgcacaagatgcagcctctaagaagtaaccaggaaaagctggacattccatacctcatatgaaaacttgaagtatgattctggaatggagacatttaatacattttgtatttactagtgatcaaaattaatgtttacagggagacttaaagatggctgcccagaagcacaggacactcccctcctccacaaagaagacacaaaatagccaatgtagataatcacactttgactagagcatctaagagagaatgctggagctcagcagagaagtgacaggaaacagctatggctctgaaggaggaggtaaggcagagggcctggccaggagcagctgggagcccaaagaggcttcccagtgagggaaaatgataagtgagtgacccctggtggtccacattcccactgtgaactcttgcacacggccacagccatctgaccagcagagctcaccacttagggactgatgattgccccacactgcccaccgtagcctgagcccttgtgcatgacctgcaggcctcaagactgacaggcccaagtgacctggtgctgagccctctccctgagcccaagcatgccgcccaagaccctggaaattgccccattcttgttcaccacagcctatgcccatgaacatcagatggggggtaggagatgcctaaggacaggactgcccagtttggcactgttcccctagtgcccaagcctgccaccttggggacctgggaattgatcaatgtttttggacaccacagtgcatgcgtatgcaccagggaatctagaacacgcccagaaaaccttctggcagtggtcaagcatgccgtcaggtctgggaacctctctggccggtccaccatgactggcatctgtgcacccctctcaggagcctgaggacaggcccatccaacctgctcccaccactgctgctagcacccacctgcacaagctctacctggaagcctgaggactggcctgtccagctggttgcagccaccactaacaccagcgcatagtgcctgggagcctgagggttgtccagctactgacattacacatgccatgcacgttgcttaggggcctgaagactcaccctcctgcccaggtcactgctgctgctaccagcacaaaagcaaactaactggaggcccaaaaatcagcctgcctgaaaccagtaacatcagttcccacagacacttccctggggacccaaggacaggcaaactcagcctactgatcctaacactggggcccgaggactggcccatgtggcatccttattctcagcaaaacctcgccatagcctccactaacaactacagcctaagccactgaggaaagcacaaacactactgtccctgtttacagctgagaaacatcatatggagactacacttcacacacccagaaccaaagctaaagtgccctacccaaccaacaccacagatacagccacaggaaaaaatcttcccctatgacagtcagcctccaaaattggaagaagcaacggttataccagatgcacagatatcaatgtaaggatgaaagaaatgtaaaaaagcaaggaaagatgacacctccaaagaaacaataattctccagcaacagattccaatgaaaaagaaaattatgaaatggtgaaaaatgaatttaaaataataatattaagggagctcagtgagatataagagaacacagataatacaaagaaatcagaaaaacaactcaggatatgaataagaaatttatgaaaggaatagatagataatcatgaagaagaatcaaacaggtatcctagaaaggaagaatttaatgaatcaaataaaaaatacaatcaagatcttcaacaatagactaaatcatgaagaagaaagaatttcagaacttgaagacaggtctttggaaatagcccagtctgaccaaaaagaaaaaaaagaaagaaaataaataaaaagaatgaagaaagcctatgtgttatatgggacacgataaagttagaaaatattacaaatttgggtgttccagaagatgaagagaacaccaatgacatagaaaaggtatttaacaaaatgatagctgaaaacttttaaatctcgcaagagatttagacatccaggtgcaggaagctcagagatcgccaaatagatacacctttgttttttttccctgacatgtaatagacaaaatgtcaaaattaaaaacagaatcctaaaaagagtgagagaaaagtgtctagtcacatataagaaaacccttctgtgagataagacatacttcaccccattaaaaatatttatatactcagaaagaaccaaaatcacctaaatatggtatgataaagctgaaatacatttcctcattgacaatgactgcgctctgtacaataatatcatagtgacttccactaaatatttggttttgtgtagtacaagtaaatatttaaatgtccaagtgattaaaaaattaaatggctgatttagttacacttcatttttaaaaagatattgtcatttctttctttccatacttccactaagaatattttgtattctcttccaattacaaaaaaagttcttatgtaaggttttgaattatattttaaaatgtctatctgagatgtcacagtgtttgaggatcaaaagcttagtgtttgtgatcaaactgcccaattctgaattccaactctgccattcatttactgggcaaacttgaaaaattgtttcactgtttttgctgtcttctttaaaatgacaataatataataataggactattcataggactgttttgagtatttaataaaatgtgtaaaagctatgcatagtgtctggtacatatcagacattcaataaagattgcctattttcattgtctttctttctctctttctctctctctctcgctcttgctctctctctctctctctgcctctcccttatgagctttacctttgctaaccctttcacaggaacaagtggctagttgttcactttagttcttttttatcctataaattcaatattattttgttgtaattaacatatctttgtttagatttaactttacgtttatcaatttatttgtttgtttttttaatttaagatcatactgctgggactattaaccttctttcaagaatgcatcttttaaaattacataactgaaagttgatgactaaaaatgctctctgatctgagtttaactgaagatgtttgttaattctttttggctttcattcttgtaagaaagtcgtgttctgtataaaattctaggtctcaaaatattattttttcatcaatttcagatgtcattttactctcttcaggaatcttttgttgctgaaaaggagtctaacatcaatgttacctacacatgtcttctctctgccagctttcaaggtcattttttaatttttgatatttaagtcaccctataatgtaaactggtacaatgtatttattttctattgatgcataacactttaccacaaatttaccagcttaaaacagtacaaatttatttgctaccagtttctgtgggtcagaagtccgggtactgcatgtctgggttttctgctcaaggtctagttaaagtgaaatcaagatgttacccaggctgagctcccatctgaaggctctgggaagtattctgtttccaaatttactcaggctgttgacaaaattcagttccttgaaattgtaatactaaggtacttatttccttgctggttgtcagatgggggctgcttctgctagtagagatcccccacgttccttgccgtatgccttccatcgtaaaagccagcagtggagaatcttcttctcatcaaattcgtctcactctttaaaatttattttgccaggaaaaatccagtccctattataagtttacctgatttggttggattcacccaggatgatctccctcttttaaggtcaactgaattggaaccttaataacatctgcaaattcccttcagagcagcacacagattagtctttgactgaataatgtgtgccatacatggagtgggattcttctctgcgtggtttcatttgttttgtaggtctagaatattgtcatctattacctggttaaatatgctctcatcttcattatcgcacttgtcttctcctggaaactcagacaaacctgtgtaatatcaaatcattatatgttttctctggcttttaatctcctttttgcatacttcaactcagagtctccttaaaatgttgttgcagtgatgttaacacttctagttatctctgtaaaagtaaattgacatgaataataaaaaacaattgacaaaaatcagaatgatggcataattgaaggtccctttttaaagctgcttctcatcattctagtcatgaagcatcccgactgtcccaagtggaggtggcatgggggagggatgctactgaaaaccttgttttattgaatagtctgcaagtatatattattacagattatatacatcttatgtttatatgaaaatcatgtatctctaaaaaggcattcttcattcatatcatataatatttttactatcatagagcagtgtacctgaatagtacatagctctaataacctaaaaatggccaaatgcagtagtcttcttcaataactagaaggctacagatctaagtacttaacttacatactgagtaattattttggtctctcttccagattggcaattctcttttaagctatatttaatatgctatttaaccattaatttaattttccttttaatatgtacatttttcatttcctttccccccagctctattaaggtataattgagaaataaaaattatatacatttacagtatacaacacgatgttttgatatatgcaagtacacattgtgaaataattaaattaagataattaacatgtccctcttctcatataattattattttttgtggtgagaacatttaagatctactctcttgcagttttcaagactacaatatattatcattaactatagtcaccacactgtacaatacatctccagaacttattttctttgtccaacacttatattctttgaccaacacctcctcatcccatcctctgccagcccctggcaactaccattttactctctgtttctatgatttcaaattttttagattctacatataagtgagataatgcagtatttctttttttgtgcctgctttatttcatttagcataatatcttctgggttcatccatgtttttgcaaatgacagtattttcttcttttctgttttaaggctgaatggtattccattgtgcatttgtaaatatatatgtgtgtgtgtgtgtgtgtgtgtgtgtgtgtgtgtatacaattatatatcacttaatgacagggatatgttcagagaaaagtatagttaggaaattttatcattgtacagaaatcataaagtgtactgacacaaatctacagcctactaaatccctaggctatgtggtatattctattgctcctagactactaacctgtacaggatgtcattgtaccaaatactataggcaattataacacagtggtaagtattaatgtatcccaacatataaaagtagaaaaagtacagtaaaaataaagtataaaatataaaaatagtatactttaatagaaaacttaccttgaatggagaatggaggactggaagttgactctgagtgagtccacgagtgagtggtgagtgaatgtgaagctctaggacattaccatataccattatagacactataagcattgtacatttaggctatactaaatttgtttttaaacattttctttagtgataaattaaacttagcttactttgacttttactttataaactttttaataattttcaactttttgactctttaataaaaacacttagcttaaaacaaaaatattttacagctgtgcaagaatatttttctttctttatatccctattttacagacttttcattatttttaaattttaaatttctctttttcactttttaaactttttttggtaaaaactaagacacaaatacacacgagcttaggccaataccggtcaggatcatcagtgtcactgccttccacctccagggctcgtctccctggaagttcttcagggacaataacaggcatagagctgtggtgtcctatgctaacaatgccttcttttggaataccaccaagggacctgcctgagatcattgtaccattaatcttttcttgttttttaagtagaaggagtatactctaaaacaacaacaaaaagttatagtatggtcaataaataaacaagtaacatttcatttgttatcattattaagtgttatgtattgtatgttacatgccttttatgactggtaggcctgtagtaggttgtttatgtcagcttcaccacaaacacatgaggaatatgttgtgttctgatgttaagacaactatgatgttcctaggcgataggaatttttcagcttcattatgatccaatgggaccaccattgtatacgcggttcattgttaacagaaacatcattatgtggcatgtgactgtgtatatatatatatatatatatatatatatatatatatatataaaaccaacctcagtgcattgatggatgatgaacggataaagaaaatatggtatacgcatacatacatacgtatatatataaatgtatatataatatatattatatgtatgtatatacacacatacctatatacatatgtatatacatatgtacgcatacatacatatgtatatacacacacgcatacatatgtatatacgtatatatatgcttatatatacgcatatatgtatacgtatatatgcgtatatatgtatatatgtatatatgtatacgtatatatgcgtatatatgtatatatgtatatatgtatacgtatatatacacatatatgtatatatgtatatatgtatatgtatatatacacatatgtatatatacacatatacatgtatatatacacatatatgtatatatgtatatatacgtatatatgtatatatgtatatatacgtatatatgtatatatgtatatatacgtatatatgtatatatgtatacatacacatacacgtatatatgtatatacgtatacatacacatatacacatatatatgtatatacgtatacatacacatatatgtatatacgtatacatacacatatgtgtatatacgtatacacacacatatgtgtatatacgtatacacacacatatgtgtatatacgtatacacacacatatgtgtatatatggatatacgtatacatacacatatatgtatatatggatatacgtatacatacacatatatgtatatatggatatatacatatatacgtatatataaatacatatatacacatatatacacatacatacatacgtatatacatatgtacacatacatacatatgtatatacgtgtgtacatacatacgtatgtatatacatatgttacatacgtatgtatatacatatgttacatacgtgtgtatatacatatgttacatacgtgtgtatatacatatgttacatacgtgtgtatatacatatgttacatacgtgtgtatatacatatgtatgcatacatacgtatgtatatatgtatgtatatgcatatgtatgtatgtgtataccatatttatccattcatcatctatcaacgcacttaggttggttacatacctcaactgttgtgaatagtgcttcaataaacatgaagtgcagatatctctttgacatgctgattttatttcccttggatgtataccagaaatgagactgctagaccgtatggtagttctgtttttaatttttgaagaattccatactgttttccatcatggctgcaccaatttacatttctaccaacagtgaacacgccttctggcttctttacattttgccaacacttatcttttgtccttttgatagtaactattctattaataataacagatgtgaggcaatatctcactaggaggttgacggggagctcagctcagcaccagaattctagttgtcatatgaggaaacaatagctaagatttacctatcactaacatcagcaatcacacaacacctgtatcacacagaggaagtgatctgtgaccatctgcactatcttaatgtggaggaaaagttaaatattagatttgaactcaattgaacatggacacaaacaatggttaccaagtcccagaacaggttgtgtgaacaccttgaggtgttcattcagagctgttttggagaaatctctatttcaatctattcctatacgttagttattgaaaaacaatagacaatcacaaaaaacaagttgactttttgtgttccttgagcccagtcacaaagggccctcgtaactggacctcatgccaaacaactcgttacaaaaagagatagggtcccagactgtgccaaagcttcatgacacctctcctcatctgtaaacagacgagtgaccgactctggagcccaggctgttgcttcccggtctagtggtgaatcctccatagtctggtgagtgtaaatatcttttcccttctctccttcccattgcaatttgcttattatatcaatctatttattatatattattatatcatttgcttattatacctgcattgccatttacatgggataaagattgtttacccttaaaggtattgtgtttgtgtcttttcttctcccctcgtgcgttgcccacacagaacacttattcacataagataatcccaatccctacctcttttgccatataaaaaaatttcgataggccagtgaaattaaatttaggaactggaggaaaaggagcaaaaagatagttgaagagagaagggacatcttgttgaagttaccttgaaccaaacagtgaccgtgaatataacaatttgagtcaggccagaaaataaatgaataaatcaaacactatatctaaattttctgattatcttaatttttcttacctctgacaagaaagaatgagcttgtgtttttatgtcaaagaaaagtgtttcagttactaaaagaaagcaggttttatatttgtatatagtttattgttgaatgcacagttcacagcctctgttgaaaaattcgatcctatagaaaaagttgtcactcaatttgtaatgtggacaggaaaacttttttttcacagaaaacttgtattgccaggatcctctatgttccatgtagcttgattttttttataaagatcaactaacactgcttaagcacaaatgtggtatatattgtgttagaattatatataaatcaagtagcacagacagagcaaaaacaacatgtaatacaatagatttctttatttgagatgtaattttcctgataaaattgctatgcttcatttccagcaatatatttaactcaagtagcataaaaccagggaatgtcagaaagctgccgattctccagagaaaggggctcatcttattaagcaatgcaactgtgacaatgtgtaggatatttctcaattaattttctttttctgataaggtattctatacattggggaacatgatatgtgtgaaggtttctcaatagcattactgaaaattgatttatgacagacagaatcaagatcatggggcccccaaacagcctcttggaagagtgattttccaacatgaaataaaagtaagatgattcaaaaaattcatcagagaacaccctatgtgtaatgaatgtctcaggagccttagccagctaaaaatccaatctattttctttagaagagattagaaaatctctaaacaactcaagccacctgcatcactatttgaaatgaaataaagaagtttcaattgtttaacattatttaggctccaggtacttgtactaaacttcagtaagagaaaagactctcaaaaatagaatgcataaaatgttaaatgcataaaatgcataaaaagactcccaaaaatagaatgcataaaacgttaaataagacacagatttttgtgaaggaagttacctttattattgctctccaatttttaaaggtttaagttgtgctgtttgaagactctgaactaggaagataaaaatcaacatcatttgaataagtaacaacacctatatcgtgctgacttgccttccttcattttcagttacatcaggatttcctcatattagtcttctttgtatgctgacctatattctctacttgatttaaagtagatagcttacattatgtaacggctagatttaaagtagtcgccttacgttatgtagtggttgttaaattcaattgaatttgacctaaagtggcctctatatgtagtgaactacaacttaacttagtatgtaaactaactgcaacttaagagtatattcaaaaccacagtaagatgccatctcacacaagtcagaatggttattattaaaaagtcaaaaaatagcaggtgctggcgagattgcagagaaaatggaacacttatatactgttggtgggagggtaaattagttcagccatgtggaaggcagtgtggtgagttctcaaagacctaaagacagaaaaaccattcgacccagcaatctcattactgggtatatatccaaaggaatataaattattctactataaacacacatgcatgcatatgttcattgcagcactattcacaatagcaaagacatggaatccacctaaatacccatcaagactggataaaggaaatgttgcacatatacatcatggaatactatgcaaccatgaaaaagaatgagatcatatcctttgcaagaacgtggatggagctggaggccactgtccttagaaaattaacacaggaacggaaaaccaagtactgcatgttatcacttgtaagtgggagctaaatgatgagaacacgtagacaaattttctcaaaagtcttaaaaatttagattcaaaatatcaaactttaacatttctcttctttatacttattaatagattataagaaatttagcctcacttatattaaatatatggattactaaggatgacagtgtattcatgtattatcattatacatagaatattataagaatcatatgaaagaggggtgtggtggctcatgcctgtaatcccagcactttgggaggccaaggcgggcggatcacaaggtcaggagattgagatcatcctggctaacacagtgaaaccccatctctactaaaaatacaaaaaattagccgggcatgatggcaggcgcctgtagtcccagctactcaggaggctgaggcagcagaatcgcctgaacccgagaggcggaggttgcagcgagccgagatcgtgccactgcactccagcctgggtgacagagcgaaactctgtctcaaaaaaataaaagaatagtatggaagaatgaaaatagaaaatagtatttttatatactcaacttttaacatattttaccatagagcaacttatacatgtgtggttaattatgaaataatctggttttatcaaaacgatccctcatcaaattaaatgttataaaatttcctatgaaattttatgaatttcattaaattcctatgaatttaatttacatgaattataagctatactaataatgcaagccaaaaaggaaccctgatgataaagtcaaaaattcttctaatatgagaaatgttttagtctgctacaaaaaatgtggtcttacatatattcttttcttttcttgtttttttgagacagagtcttgctctgtcacccaggctggagtgcactgacaccctctgggctcactgcaacctctgcctcccaggttcaagcaattctcctgccttccaactacctgggactacaggcacgtgccaccacgcctggcttttttttttttttttttttttttttagtagagacagggtttcaccttgttggccaggctggtctcgaactcctgaccccaggtgatccacctgcctgggcctcccaaagtgctagtattacatattacaggcatgagtcaccatgcccagccacatttattattttcagtgttgattgttaacccaagtaaatagtgtgctttaatttatcagccagtacttctataaaagcataatctttagcaaaacccattactgctattaagtctttatcatattgttttaaaagccagttcatttatttgtttaggtaagatattcacatagtttaaaaaactatacaaagttattaaagagatttctcaactctacatctgtccttattcaacagttcttaatgtttttgccattttctggtgtatctttcaggggtgcttttcaaaaagagttttcttttgtatcttttcagggtttctctagcctatataatatgtataatttgaatataaaattatctatattctgtctcactctctctgtctcaaaatcacaagtgatagcacacttggtagtttcttaggtacttggttttcctcttaaacattttctgagttccaatgttagcctggtgatgtggagagctggacagggcatgactttcatgcttaaatctagagaaaaactagataaactgaaaattaaatttgccttgaaagcattatagaactaaggtcaaagggaaaacaactttcgacagttctagagaaagagacatggctatggggagaaataggactagatccattgcttacctgggacaggcattgccaaactcattactgtctagtggagaattgttatgaattgctaaaggctgaatgtgggtttgcatgagactatgaacccccagaggttgcagaaataggagtgttcacaattttttgtaggcttttcttccaggagccctcccaggcactcacaggaagataggggagtatcctgagaaagcttcccttgtgcagctagcaaagggagagccctaccatccctctcaaaacacccagactcaactccctgatctcctatacagagaaaacaaaacctaatttgcagggagttggtaaaaacaaacaagaaacaaaaaacctgtagcacgagggcagtagtggaaacccactgaagctgaagaagggaaataggtgtggaaggcaaggggagggaagctagaaactaccaatgtgtgtggggaaggaaagcagtccaggcccagcactgggtctggatgcacatggaaggcaggccactcggccagtgttcaccgttccttcttgagactgaggttaactagaacattaaaaaatacccatttcccacattccccctaccacaccagggttgagtaaaaataactgaatcacacaggtgggaaaccggcaagaataggctctctggagacaaaaacaaagaaaagatcagaaatcaaagtcaaagttagaaatagacataagctatcactagagaaattgaaagcctctggtgactataattaataagattgtattatatgcctgaaaattgctaagacagtagattttaaatgttctcaccacaaaaataagagataacaatgtaaggtgatagaaacgttgattagcttgattatggtaagaatttcacaatatatacatgtatcaaaacatcatgttgtatactaaaaatatatataattatgtttatgtgttaattatacttcaattttttaaaaaagtatatattagaaaagaatcaaacaaaaatatgaagtaaaagtgaaatataacttgtcaatcaaaaacaaaaaattcactgcagccaacacaacctattctacaagaaatattcagaaagctttttgcatggagattctgatataggtcagaaacttagaaatacagaaagaaatatagagcattgaaaatggaataaatagaggtaaataagttgtttcattattaataattttttaaagatgactgagtgtttaaagcaatataataagagtaaccatgcattgtgtgcttatataagatatcaaagtggaatgtatggccatgattccacaagagaagagatgaagaaattggaaacatattgccttacacgtgaagccatataatattattcaaaaggggctcagatcatttttaaatgcacattttaaagcacaggagaaatgactaacacataggcaatagaaaaaatgaaatgaaataggaaataatggccgtttaaacacagagaagaaagaaaatgattaaacaatcaataaaacaaataagaaaggctagctagttttaaatacaaatatatttaaaactaccaacttagtttgaacataaacaggccacaggcatttgctgccaaatctattctcagggtgtggagagttgttgaaatgtcagaatcatggcacctttcaaaaatacacaaataggctccatctgaagattgtccagcatatgttttggtttgttcttctgcaatagggtaaagcaacacaattttcgagatacaaaatttaagaattacaaaatatgaacaggtcagaataactcaaatgatcatagtactatcgcagaatctgcagcaggtgcttttcttaactgtagacatgaactacctggcactgtacaactttgtgttgcttcagacacactgctttttacacacctcagtgattttatattctgactgtaaccattattttggggataactatttttagttttataataacgccaaaggaagcacatatactctagagaatactgatgattcaggataatattgctcctgacccctcgacccctacactgccactcaaacacaaacttacagtacactttattaataccctgatctataaacagtatcctaatattgcaaagaaagaagaaaacttctctgtaattttgtcaatttcagagtcattactccatttctgcactttgctcttctttaggatacaatccctttgagatcgctagtttttactcttagctggaaattcagtacatgtgatcattttccttgtatagagctgaacacagcaattgtgagagataagctgagggtcaaaggattacagtagtgataatgcgtttgtatacgtgggtcttaagcagtgccgctggtgggggctgtggggctttggagagggcaaagatagttttttcttcttacttctattctctgctgtcttgtgccctgggaggctgatatctgtatgcggcgtcattcagccttccttgcatttcacttttcatgaagtttggccaatggaaatcactagctagaaaacagagaacattctatttcttaactgtggctccagctctggttcagtatcctcacaccctcaactgtgactcttgccagattcttaataatcttgtaacagcttgtaatcactccactggtgtaaaccctagatacctcaccatcatttgttgtttcatttaattattcctctacctctggaaatagttcctttgttaaacttttttcatttattttctcaaatggactatttcatgctgaaagtctgcaagatacagtaactggtaccagcagagatcccaagaaacgtaccctcaaaccaacattctggtgttcggttagtcacatatgtcaagtgtacctataacctctgatatggttgggatctgtgtccccacctaaatctctgttcagttgcaatccccagtgttggaggtggggcctggtgggaggtgactgggtcataggagcggagttcttattaatggtttagcaccatcctcgccttggtactgtatagtgagtgagttctcatgaattctggttgtttaaaagtgtgtagtaccttgctgggctcatgcttgtaatcccagcactttggaaggccgaagtgggtggattattggagcccaggagttctagaccagattgggaaacatggtgaaaccctatctctataaaaaacacaaaagttagctgggtatggtgatgcatgcctatagacctagatactcgaaggctgaggaagggggatcacttgaacccaggaggtagaggttgcaatgagccaagatggcactactgcactccagcctgggcaacagagtgacaccctgtctggaaaaaaaaaaaagtgtgtgcggcacctcctccctttttctttctcctgctcctgccatgtgcagtgcccactcaccctttgccttccaccatgataataagtttcctgaggcctctccagaagctgatcagaagccctcatgcttcttgtacagcctgtgaaactataagccaattaaacccctttcctttataaattacccagtctcaggtatttataagagcgcaagaacagactaatacaacctcctaatcagagagaaatgaggcactggtaatctgtggcatttggtagcatagcaattgctcagtggtagcatgaattggactgcaggttgaggttgtcaagtgatttgtggaacttggcaattacaatcattgtggggtaggctggataattccagatccctgaatataactttcaaaaatgcacaaagactaatcaaaacacttgaattgccaaccatgagcagatggaaaacttaaaaatcctcaattgttgttttaaataaaattttttctcatctgagatctagaagatgcctgtttcaagaactacacagttagaacattaattgaatgtaccacctcaactactgtcttatgctaagatatatactattgggaatgagcaaggtacatgcgaatagaaataaaagagactgaaaattttaaactttcacattctccaaaagcttccctgacagaactgcagttcctctcatcaatactctttaactttcatgagatttaccaataccttcaagagggcctggtgccacccaaggggataaggatactcctcaggatgtaccatcaccatcgttctttctcttcaagaccatgataaaaggtagatccatatggagaagtacaagcttgttctgggaggagatagcttttattcaaaaggagttgccatatcctgccaatttatagcacaaagtttatgaggaacaggtatggatggatttttaagagtgttagatcaggacaaatgttgaaccatgaagatttgatcaagctgaagttgttgatacgtgtactttctctcagaatatgaaatttagtaatttggcttgggcacctgagaaaagtgttataagtctgctaggctgatcaattaaagcctgaattcaactgtgttctacaattaatgaaatagaaatcctcttacttttctagcatacttaaagaaagtacacaaaaggctcagggaggtaagcctagcaagtaactctgttatatgcaaactgctcagacaccatttactgtattaactggagatactcagaggacattccatttatcaagatattaagaggcagggaggggagtaagcccaagatgaggttgcttctctattcaagtagtcactacactattgataattcaacaagctgtatattttgattggtatgtttattcatttgtatgctataggtttatgaaaatgttaacatgtgttagtgagggaagcacacacatccttgaatacacaatttggtgactgtcctctgaggcctgtgacaatggtgaaggaagtctcaatggaattggattttattattttagtggggataataagatcccaacaggaataaatctaacataattagcatgatatgctactgcaaacctgtggtaaccagatggccctggcatgctgcaatccatggataattgatgacaaggtccctatgaatgagatagctggacagccttctaaggggttgtttggccaatgcatctcataatgtctaggtctgtttggccaaaactcaacttgagttaaactagtgtggattctcagccagtaataataagaatgcactatgaataattctcacagctcactcagagacctggggaaaataattttctcaaatatttcaagggttatttcatactgtcagtggactccacaagttcctgggggcacaaatcaccattaagataagagtaggtacttaggggggtcaggtgatataatagaatcttgacctaagcctgaaaaaaaaattgcaaaactgatgacagaaaaggacagaaaaaaatacgtaaatggtcttattataatgggtaaaaattatgaacatattcatattttgtgtaaaagtccacccaaaagcatctgccaaaggagaggctttcaacaatcacgtgatcaaaagggttactttaatatccatgtactcaaaggcactgaaagtgtctgtgacaggtagggatgttttgtagagttgtaattttttgttgaaagctggatgttatgtctcaaattgtaggaactcaggaaataaagttttgagtgtgagattttttgttagtttggctaggagttgcgctgatatttgctgaagctctaggtgccagggactattgtttataatttttctggtttattttctctctttcccttcttgtcttggttttccctagaaattgcatctttagtagtgctggtgtcttgctgctctgttagttgtaatgtgctgtcataccggagcactcttgttacggtggcaaggttttgtggaatagagacatttgataaccttacgtttaaatctaaattttttagttggcctgtgactttggatgcactccttagcctttttctccttatgtgagatgcttagactggagtggccttcagttggctagttgtctttcccggagtcagagaaaggtctcctaaatgtacagtgatttcctttgtaggacagggtttttttatggagatttctttgggcctatttcagaattattattttccccctactctggccaaaacaagaggaatttttttctcttatatttaccatcaagatggggggtgtctcccaaaaataaaaccaaggaaagtgcagaggtgccaggaactactgtaggctgagctcctaggagtttttagctctaagctattttttttttgaggtggagtctcgctctgttgcccaggctggagtgcagtggcatgatctcggctcactgcaacctcagccttcctggtccaggcgattctcccacctcagcctcccaagtagctgggattataggcgcctgccactacacccgactaatttttgttttttttttttttgtttttttttttagtggagacagggttttgccacgttggccaggccagtctcaaactcctgacctcaggtgatctgcccgcctcggcctcccaaaatgctgggattacaggcatgagccactgcgcctggcctctaagctatttttttatgtagcctccagcatctcattaacgttgtcatttaaatgtttctattagctactggccctactggctacatgtcaggttagctgatctcagctgtgattctctgtagtcatctgtctatccagattctggggtgtgcatttgccttgtgacatcaattctttgaggtatttaaggaagtttactgatttttagtttgctgaggtttttcctatcgtaagggtaggaacaataactgaaattggaaggtttcattgtctttttaaacattaattatttattcatcctatattattgtcccagatacctcataatcaaaacccttgagataaccaatgttttgacttcgattcttggaggattatgactgaattggcatcacctctcagtaacattttgaatatgattttgtgattcaccagtgttggcaatagtttgttgttgttactgtttgttctttttttctctatatgaaagacaattattggtgttcagagaaaaaagaatagactttcctaggtttgttctgtttggcccttcatctgtgttcacagaacttcagcaatcttctgctgcaccaggaaactagtccctagggcctcaatcactggactcttgtcttctggttttttggcaatgagtagcctcagcaacaaataatagaacaggagaattcagaagtcagagtattttttccctttctacttatgtggcaggccatgatttggcagagtttgtgctcctataattatggtcatatatactgctcagtggactttcctctatgacaccgtatctcattaggccctggaataccatttccttcccttaccaattcagacctaagggtggcaacaacttctcactattgctagtccctggtgattcttgcttcatcatcctttactattcttttaactctgtccacactgctcttaatagtccacttgtgaaatgtcttcatttatctctggtaatatattatgttttgattgtcaagactcagactgaccctgactgattcaggcagcataagaccactcaatttctgagggaggggaaacatacatatggtaagtacagaatacgaagaagaaaggaaggtgaacaagtgtaaaatataaactttacacattttagattttgcttcatcaaaaaaaaatttgtgatagaagatacaatgactgtatctaaatcacaaaattttacattgcacttgatgtctttctatacataatatgaaatgaaagttaagcttaaaaatgaacgtgttaaatatttaaacatcacatcagatttttcttaaaccacctcggtttttttccgaattgaacatttttctattgcatattccagctgagagccatgttgaaatgagtgttaagaagtcttcttagtgatattattactttggagctttagttgccataacaacttcctttacctctcaaaaatgttgaattatatgtcaaatagcagatgcttcttatactcattgaaatcacgagcactgccattcaacatagaatattaaataaaaatactctagcaaagcaacaaataatttgaaggacaacttttagttgtgataattaactggaagtaaaattcaattcacatattttcctttgtaaataatttttcttgtctttaatgtaagaaagcattttgttttcttgactcagtcttgaattcattcaacaaatttgcctttgcaaaagttcagcagggagtggtttctctacatatttatattacaagaaaatatttttttctgctgtagaaataaatgttataaattgtctacagggaaggcataatttatataccaatttaaaaatttaaaatagaccaacatgtagacatgtctcacctttcgaatacagattttgtccaaagtgtaaatatattttatacattgagaagtatgatgtgaatttaaattattttgataatatatagtattatagtaattgcttaaagtaatgcttttagcttgaaatagtctatttagatttaaaatacctggtttagactggggttaggctgagagtgctagaaaaaacttcatagacagcttcaaatctttgtcatggagaaaaaagatctgtcaagttactgaataaatagccgaaattactcgaattttcatgtttgtaaaaggttgccattatcataatattacagtgtctatactagcagttgtacaacttaataatgagtaaacaaatgctgcatgcctaacagaaaaataacaaaatactttagttacaatatacatagattcatttgaaaatattttaatggtatagcatataatatgtaacataatgctaccacattagatataaaaatatatcatatgtgctaagtgtataaataatatattggattatatcatatttcagtgagtgttcttagtgatttcagcatttctctctcttatggttatatgtgattaaatttttattgtttttaatgtttgttattcagggattacataagacacatgagtaaggagtcaattacagagagaatggtaataatagcaaaataagtaatgatagctaatactttttatagcacttattagatacaaagtactgtcctaaatacattcccccatgttatttcctttcatccttatgtttaccctgtgagttagatattatttttcacattttatacatggcaaaacaaagacacaggaagaagttaagtaaattgacttggacctaagtaatacgttgaggattcatacttaggcagtctggccacagtgtccatcagtagtgacatagtcctaccttgtagctccacagtgttaaccaaaacccaatatccacgcatacttccactctgccatcctgtgagaacaagatggttgtttcctctctggccacctgctcatgttccatgcagaatgaaccatcatgaagaacaaacaaaaaggggtggtgcaattaacaaagtcaaatgtctttatttcctagggctgccgtaacaaagtgctatacactaagtggcttaaacaaaacatgtatatatatttatcacagttctagagattagaaatccaaaatcaatgtgcaggtagggttggttacttctggagacctctccctttggctgatagatggctgttctatctttttctttacatattcttctctccgtgtaggtctgtgttctaatcgcctcttcttgtaaggaaaccagccagactggattaagtcccatccatattacctcatgtaaccttaattactactttaaatagcccacctccaaaaatagtcacattctgaggaactgtggggctagaatgctaactgcctgagggtttattcctgcctccttacaaagaatgaccatgacattgtagtagaaagagtttaatagacacaagaccagccatgcaacatgagagatggagttaatactcaatctcttccaaagcttgtaggttagaagtttttcaaaggcattttaggagaagaagtgggggtggccatgtaacaggtgcttgctgcttattgactggggaggagataaaataataggggattgaagctgtcttcctgcaggttgaatttttcctggccgcagcagcagggttggcagatccaagtagtagagccatcagatccagatggagccatgggtgtcagacatgcaaaaaacctgaagagatatctcaaaaggccagccttaaattctacaatagtgacattatttgcaggaataattggggaaattgcatatcttataacctccagaataatggctgacgatcatttatgtctatgccttagcaggactaaggcttctctcctcccaccagcttgacggcctttcattagctttacaaaagtggttaagtttttagcaaagcctattaccatttaaactatagcctaaattcttccaaagttatcttggcccaatagcccagaaataattaaagaaaaggcaagatggggtgtgggttagctcagatctctttcattgtcataattttctcactgatacaatttttgcaaaggtgattttattaacatataactttttggaaggtaaatagtggtggacaatttagctcataatgttagtggcagtaaatctgtatctgaatgggtctagagcagtctgaattcttgcctcctcagaagaaagactttgattgaggggcataatgtagaaggagagaccaaggtaggttttacagcaggagtgaaagttgattaaaaagtgttagagcaggaataaaaggaagtgaagtacaactggaagagggtcaagtgggtgaagggtttgagatcccttcttccctgattattcccttgggttgggctgtccacatgcacagtggcctgctagcccttgggaggggagcatgcgcagcgtgtttactggagtagcatgcatgctcacttgaggcattcttcccttaacagtcgaatgtctctaggaggttatgctccagttaaaatctgccattttgactcttaatgcataaacttgaacccactcacccaactgctgagaacttatctggaagctgatgctcaccagtttcaggtgtttctggttactgggagactgcctttctctggcactggctgggtccagttattcttttagagatggatatggacaggagacagggaaatattgggtagaagagggtggttccccatcaaaggccccaccctcaagcctggttacccgcggccctaagcgagaacaggcatttctgcttttgtgcccaaaaagttgcctttgggtccatggtgctccctatcctgtacccatataaaccctgaaccccaggctccagaagcaggagacgaacagtcaaatggcagaactgagcagcagagaaggagagaagagaaggagcaactgaatgctgagaggagtttggctagggatgatcagagaggagatcagccaccggatggtcaaactccagggaagatcatctgcccaccccagcccccttccggctccacatccatcctgctgagagccacctccatcactcaataaaacccctgcactcatccttcaagtccatgtgtgacccaattcttccaggatgctggacaagagctcgagatacagaaagctgtcacactggccctctgcccttgcaaaaaggcagaggggtccactgagctggttaacacttaagccatccatagacagcaaggctaaaagagcgcactgtaacatacgcccacttgggctctgggagtcacaggttcccaaccctggatgctgccgtggggccgaagcccagcaccccttcccctgcacctgtctgtctgcatgcgccccctcccttaaggggtttgagtagcagcggtgaccaaacagacgagccacaccgtgttgcatgtcctgttagggaggtcagggaactcttccatttcagagagatagtttaacaacagcctgaccatcacctgatggtcgcctgacattcctgggggatgtcggggagaggggctctcctgccctgttcatgtctgactagctaccttctgtaaaaataacaccaaattcttccagaaagtaccaacagctttaaccttaaatataaaaaactgtaagataactctcctagatgcaaaaacagaaaagaaattgtgctgtgaaggaagaaacatagatatttgggcaagcatttagaaatgcctgttacagtatatacctttgagtcattttgtatgtcacgccaaccctgctattgtaaaaccctatgtaaaatcacctatttagaattgttttaaaatactgaagctagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccctctcaaaaaaaaaaaaaaatactgaagctagtttatctcaaagcctgtatgtttccagagcctgtgctctggaaaaaccctaggctttgaaatgcagattataattaattgcttatctacactgggtaggaattgtaagacctgaagcacagaaatcattaaaagggggttattgcagtgcatagttggtcttgtgcaatgctataattaaggaaaagatattgatggtatggaacattaaattgtaaaagtataaaaagctaatttcaaagatgtgaaaacttctgatctgataggatcccactttactgggacataaggtcactcatacaggacatttcatgagggactatggaagtactggtgaaccacagttgctttgaaattacatttactcttttttcaagcttcattataaactatatccattgtttaagccaagtaaaggggactggacatctgtatgcagttttctaagggttgtatttctactaattcataacatgtcaaggggctctgggcttccgtggacactcaaaatttgcacacttcttccaacgtgtagaacaatcattattctccctaggaagataatccaaagaccaggtagctaatttataactttaaaatccagattttctaggtgataaatttttctctctattatactggatgtagcttttgtaaataatagagataatctaaaacacaattttctttccctaaacataacaatattaagtgaaaggtaaaaaaaaatagaatgatagcatgaaccccaaatatctgagacaggtcttaatttagaatgctgatattgccaaggttaaggacacacccctacagcctcaggaggttctgacaacatgtgtccaaggtagccagggtacagcttgcttttaaatattttaggacataatacatcaatcagtacatgtaagatttacattggttcaatctggaagggcaggacaactcgaaagggggtggtgttccaggtcacaggtaaatttaaccatattctgattggtaattggttgaaagagttattatcaatagaaaggaatgtctgggttaagatagggattgtggagacctaggttttatcaggcagatgaagccttcaagttagcaggacttagagagaatagaccgtaaatatttcttattagacttaaggtttgtattaacgttcatgctgtagggatgcagtgaagcatatccaacccccacttcctgccgtggcctgaaccagtctttcaggttcaattttagagtgggctggcagaggaagaggaagtccattcagatggctgtgggtgccttcaaattttgtttttgcttacaataagaattagcattaaaagccctaaatcaggcagaaagataatagaaaatatgtaattgtcactggtctaaaacaattattaaatcccagtagatataatagtgaggaccctttgccatattaaaatattacatttctagtgctgatttttggagacattgccttatctattatctcccacagttactatttctgccctgcatgggcttccttgtccatttaatctatggaagtctatggtgaatcttgagaaaatatatttcctaacggctactcggctttcacagccaattttttgttggagtgattttgcaaagctggagatggtcttccataaaaatggttacaggttgttgacaattcagcaagatatttctcaggcagtacaattttcttaaaacctgagtttgcagtgtattttctttcagtcaatccctggtatgaacttccacaaccacatatcttgtttagaagtatctttaagcctgtgagttctcctattttaataatgatttctctgctctgaaaaatcctaaaggttttagcttaattgtcaatgctttaaagaaatttaaaatatgtcttacagtgggtgtggtgtctcatccctgtaataccagcactttgggaggccaaagcaggtggctcactggaggtcaggagttcaagactagcctgaccaacatggtaaaaccctgcctctactgaaaatacaaaaattagccaagtgtggtagcacatgcctgtaacctcagctacttagaaggctgaggcaggagaattgcttgaacccaggtggcagagtttgcagggagccgagatcatgctactgtaatccagcctgggcaacagagctagactctgtcttaaataaataaataaataaaaataataaaaacctaaaaggcttaagttatgaaggcaatctttttcaccagcaagcaggcaattactggcctctcaatagcagacaactcttaaggggagattttgaaaaggcccatggcaagagacttttatccttctaaggttatcgtcttacagaaattataataattagataacatttcatctggagtaaaggagcagttttttttaatccttcaagttgaccctcagtcaaataaacttgaagacagcagagatgatcctcagtcaaataaacttgaagacagcagagatgaaatatttttttcacctctgcttgcacattgtctatatcgggcctgtgttcatcctccaatattcagagccacactgaaagcaaaacatgccaatacccccaatgtttattttcttcccatttatactaaccatattgttattagtcagctctttcccaagatacaaaatttaacatttagaccaaatgttttgttgtagcatcacaaaggtcaccagctttccagaccccagtatttatatccttatggcccatagtgaagttctttccttcagccaatgtcacagttttcttattttatttttcacagcatcccacttccatataacaaattctgtattaatttttatttagctgaatatgataaaatcagattaaaattctagaaataaaagtgttagttccattttttattagcactattgtcactttctttgcacttgtctattttgaatatatttgtttaattaataatacatactagaacctaaaaacacctatccaaatgtgctttaaaaataatacataagcataggctaaaaatgaataatggagcaaagctatcttcctaatcccccaagtttttggatctctcacttttcttcacatgagcaggttaagaatgtctgacaaatggaataactgagaataccagtgttgattcatatattcataaatcataattcattttacctttaagataaaaattagtagaggttttatttccttccttaactatacagatggcagtgttcaatccttggtgcatatttactcaatgttttgcacaaaacaaatatttcgtatttttctattttttaaatgcaaggattgtagtcagatggcaaatttggttatattttgtataacaagtagtttaacgttgcaaaaaacccatcaggaattttctgattaataaaattggtgaagatgcaaacatacttaagacagctaatttctttttgtttgtaaacaaaaacaacactataaattttaaggggtctcttttatacatttgaatattaagggctaataaataacattcatttctttcttttgaaaaattatgattaattgataactaagacacagaaaaaagaaaaatcaagctcagaaaagaaaaataccaaatactttcatgaacaccaactggagactgtagctttaaatctgtggctgaatgtgctcacccgttgtactcagcctccctttgtggagattggtgtggcccacccaggagaatatttgatgcttctctatagacctgtattgagtatatctttctcataatgtctggggaagaaatggagagagaaatgacaccccagtgactaacaatttacagatgtttttgtttgtttgttttttgtttttattcctactcaattaatatgggagcaaatgactatcacccaccaatcagataactcatttttttttcctctgtaaggagaagtgagagatgtgggtcacatggagtaggtcagaaagttagaaaagttgacctctgggcagattcctccacagagagaaacatgaggttagaggatcagtccacatattgagaaccattttccttacgtaagccgccaacacccattatttaaggatttttactgtttcattttaaaactatattatctcctctttgaatgtctaaagttattaaaatgatgcaaagttattaacattaggaagaactaagtgtgcttctttcattaataactaatggtaatgaacttcagcaaaaccatagaactactttaatctttacattttcatagcactaatgtaaatgttaatgtaaattctatccatgaaacccacatcaattttatcaacagtcggcagtacatgtaatcagaataaactctaaaaccttataaattcaaaaaccatttctctatttttgcttctgcaaagcgaagcacttatttttacccaatgaataatcttacagtaaaccaaggatttacctctgtaaaacttatctacattgtttctttatgggctagaattagaagttacaaaatagaaaatgagaacaaagcttatctctttacaaattcacttcatttgtgccactgtggatttgctctctcactttccctaagccaacaatctagaaaggtaaggccagtggtaataagcaattataagcaaatgtattctctactcctaaactgagcagagctgaggcagaaaatttagtttcccttgtgagaagtcatgatttctatcagtgcacaagggagtgaaaaagttttaagctgctgttacttgagatatttacttgtttaaagcttacaaattgaaaatccttgatatgttaatatttaggatacacctttttaaaatgaaagagaggtaagtggggttattcgtgatttcctacaaggtcctcatcatatcttaagaatttccatttacaaatataattttttatatccctttaccaattttctaaatttattactgagtataaatccaggacgaactgaattcggttttcaagtcatattttaaacagtctgtcaaacctttttgaaacatttgtcaaccattttgaagcaattttttaaaacttaatatcaagacagactgacttttattatttttatcaatattttgtgattcttgacaaactaatgatatttgctttctatagtagatttcttcaaaatcctttctttttgttcatccttcatccctcaatattacactgacttgctcatttctgtctctctctgtgtgtgtgtgtgtgtatgtgtctgatacgtagccctaaggattgaaacatgtcagaaaagtatctgctatacattttcctccactttgcttcttcctagggtcattttagaaatcattaaaaaattcgctattaattttgaaggatcctgatgtttaatgctattcaggaacaaagaaaaatctaaggctgtgtgttatattatttatactcaaaactcttcccactagaataccaaagtagagtgattaataatggaatgttattaaatattataaacttatttaccatagaaactcttcaacatttgaacagttttccctgtattcatagaataggatataggacatatagggaaaataggaaacatattgtaaaacattataaatgtgaaagtagaaaatactccattcttgaaagaaaacaagatagctaaatatttttctaacaacagagctataatacagatggtaaaatcaaagtaaatatttcttttcaataaatcacttcaaagcactcaaaggaggaatgacagaagttacagagtacagactcccagcctggatgttattcactgaaaataatttgtttctctaatgggggaaggaactgagagtttcacctttcacttatctcaaagagcgttttctggctggggtgtggtggttcatgcctgtaatcccagcactttcagaggctgagtcgagaggatcacttgagcccaggcgtttgagaccaacctgggcagcatggcaaaaccccatctctacaaaaaatacaaaaattagctgggtgtggtggcactttcctgtagtcccagcttctcaggaggcagaggtgggaggattgcttgaacctgggaggcagaggtttcagtgagttgagattgtgccactgcactccaacctgggcgactgggcaagactttgtctaaaaaaaaaaaaattatatccctgccctttttctttaaaatgactgatttcctgtttttgtttttgttttattcaatcaagaactggcactgttttgtgcatatatctttgtatggatggactggacagctatgcttactaattctttttttttttttttggtaggtttaaaaggtatatcacagcagcaagaataaactgtggtattccgcagcattcctagtttcaaagttcttaactctcttttttattccaatacatctgaagcatatgatttgcccccttagcaacagtagtgacacatttcagcaggacagcagagtcaacttcaggacaaactcttctagaaggcaattgccaagtatgaggctgatagtggcagtggagagcctcaaattttgataaaatcccttcaagaactttcacaaatcattgtccaatgtcatttcaatgagctaatttgattactaaagaacttattgcgcattcaggaaagcctacagtagaggtttgacttatccctgttttctggttagtttgtcatgttaagtccttcatatattgtattctttgctcagggattacagttgaaaatgcaagttaagaaaagaagaaagtaaatagtatgaagggtttaaaattaaaataacactagagaaaaattactaataggaatcaggtgtaactcctgagtgctggccgtttagaattcttatgttgtatagtatattgttcaaatccttgtaatcattagtttgtctatatcagtaggctgttttgtgttttataaatcacaagtatatttgtatcaatattgggaaactactgacttgaaattattaagtattgcaatgcagacattaactttgcttcctctgactcattatggtcttgtagattatatagctagctgctaaatgtcatgacagtaaagcatcatccttctgtaaacatagttgtttggaacaaaggtaaacatctgatcggtgctgggctgaagaaccacttcttcaggaaggtcagaataagagatgaaatattccagcccatttttctagttttctatcctaggaggtttaaatgaatggcatgtgaacattaggattttaaatctaggactgacaaaagagatttctctttgaataccaattgtatggtttcttagaggcagccttgaggactatactgaagagtgtggagagttctgtttactatttctaatctaatcttcttaaataaatatcactgttatttctaataacatctaacatttattgtgcatttaccgtgtaccaaggtctccattctgtgctttacattgtctgttcatttgactttcacagtctgtacctatttattttcctattttgagaatgaataaattgatcttttaaaagctcaacgacatatatttagcaagtagcaaggaaaatgaaagattatatagtttcaaaggaaagagaaatttaccaattataggaaaacaatactaataaccaataaagaagtcaaattgtacacaggatattggagaaactgatgctgttctcttgaaaacacgaaagtcatcgaatgagcagtattgctcaaaaccttttttttttccacaaattgaacatgtgatccctaatcttttaccctagtgtctacattttggcttacagcataaaaacataccttcaaacattctgcaactatttctttctttctttatttattttttgagacggactcttactctgtcatcaggctggagtacagtggcacgatctcggctcactgcaacatctgcctcccgggttcaagcaattctcctgcctcagcctcccgagtagctgggattacaggtgctcaccaccatgcccagctaatgtttgtatttttagtagagacagggtttcaccatgttggccaggctggtctcgaactcctgaccttgtgatctgcctgcctctgcaaccatttattaagaatccacccgatagcaggtgctgcactagaagctaaggatgcagtggtgagaaagaaaaggtgttgctgtctttgcacagtttagcaaagcagacattattaaattagcaattactatatattgtgagtggaaaacacaggggaggatgagaagacacatgaagagtatctggatttagttcaaattgtctgaaaagaactttacttttaagatactagttatagaatatgtaggacttaaaatgtttgatggggtgataataaatgtcctagggaaggggaatatcatgaatgaaggcctggagatgagatattaatggagtcaatgatgactcccagatttcaggtgagcacatatcattgtcattgtataaatattaagttaattaatctaactctcacatatcatccaaagaaggatgatgagaattgagattcagcaagtaagcaggactcaggttattaaggagattttaagcaaccttattcaacaaatacatactgtgtgcctattatatgccacagcagcaaaaaaagaaaaattagcttaaaagtgtgtgttcttatagagcatgtattctaatagatgacagagagtaaagagaaaataggtgaagtcagttctactacttctgaaaatgcatattttttctaaagtcacacacacacacacacaccacacccgcacggcaaaaattcggaataaaactatgcatgtatcaaagaaagtcattccgtgctgaaagaacaggaagtgcgaagaacttctcctaacatggatgttattaaaatccagttcttttgcatttttgatagcacaattgattataaaggaactattttgcactaaagtaggcgatttcattatgcgcagttaacgttttatagagatctgatatgattaaacgtaatggaaaatgccatcagactcacaatgtgagtgttatactttacctgtgataccttcaggtcctgcctattgtacaagtataattattagtggtctctattgctttcaaaaatgttcaagtttgtacaaaaattaaatgattatacttaccattacagtttcctagtatgaaatctctcaaagccttgtagaatatgactgacttgcagtgtttcaccactgaatagtcttttataacatagaaaaacaacaaaggaagcagagaaaaatgtataattattaccaaaataatgtgttttgaaaaagtatctactatatgttgaactacacacacacacacacacacaaacatgtcccgatgcaacttctgctgcaactgggaaaactggactttatttggcagcttcaagggacaagaggagcatttatggtactgcattttgggatgaatcataaatggtcggataaataataaattgatccagaaattcagaaattgagttttgctttttttgctttattcagtgtttctcccatgaattgattatcataaacagaacagaagaggtggcaaatttatgaacacttcgttgacttacattggctcacaaaagtggaagaaagagcagattgttgaagttaatcagtgttcaggaaaatcaccaacataaaacacaggaccataggacatcctttttgtactactaaagtccttagacatggagtttattcaccgccatcatctcaaaaccctcccgaattctactgcaatttgtctccctaagtaccttctctctgtttcaaatgctatttacttcctcacatattaattgcatgaaaaagtgcctacctaattgggacaaccagatgtaatgctaagcagtcttttctcggttgagatagagtccccacttgcttagacttatcctgtgtcctttggggaattcccttgtgtggcttcaagaatgtagtttatttacaaatctcaacttcgtatctgtcctgtgttttgtatgtctttcatttggagtgacgacttgattactttatatccaccaatgaagatattcccaagtgtggtagattatgtctttatgaagcattcaccacaaatgatgaaatctgttttagtgcactatagttcccttctaatccactgtgctataaaaatacagaagaaacaaggtttaataacatgtatgttagaaaattctcctatttaatcttggtaagctcattttctctgcgattttcgataaatatattggtaagacaggagaaataaaaatgtgttatttttgtataatatgaagttgtcactaaaaacaggccttcaattttgtgaagggaaagagaactcattaaaacaataaaagtagaacaattattatctccaacaagaatgttcacactggcactaatgcttagcctacatacactgagagaatttatatgtgtgtgtgtttatgcataaaaccctgtccaaatgagtatttttttctaaattatagtttatagttcatgcagtttactgttaattctgattaatcttgaccaaaacacttgaaaacttatcaataatctggtaaggccaatattgcattcattagaatattagatttatcttccaaaatctttttttatttagttcagtgatttttcaagtttctgttatttgcattttatcttcaaaaatgttttcatatacaatttgaatgggtaccactagtttacttaatgtttttcttttaatcaatcttaaatgaaccaatttttcataaatttatcctaaatattaacatcaatttagtcattagtattttgtacaagttatatcttccatgtatacataaaattaatgtgattattaaaataaatatgattattaaaactaaagggtttcaccaatgtactatgaagaattctttcatgtatcactgagaaaataaaagggttttaggaaatgtaacgagtaattatggattgttttagttttaggacacgtgatgttaaaatgatccatcatcacttctgtgtagctgattagaaagacataagatgattccttttaaatgaaacacacttaccattttagtgagttcaaggaaatacaatagaatgtaagattatattactgtgactcagaaaccaacgaagcacgtccgcgcgtgatgtttttcacattaagaaagcaaacgacattaatgaggtcaatagagcacaaaatagaaaagctcattaaatctacatgtcatttcatagctaacaaagttttactgggttatatatttaaatatctacagacatgaagagtatattgtacaagataagttgacaattcatgggggtgtgactatttttctttcttacacacctacataaacacagtcaataaggtatctccattcagcacgtggaattgaagaaaaaaaattatagcacactcagtgtctccagaattagacctctggaaaccatagtatctgaaataatacttaatggcattgagaaaaaagtgggagtcatttgagtcttctgaatgtcatttaaagggttatttgacaataatcaatttctaggattataagaacaaaatttatttgctaacttaaaattttattgtcagataaattcatgcttgcaaaaataagactcagaaaaaattctcaggggaaaatcttttttaaaataaccaataatcatgccaggagcagtggctcacacctgtaatcccaacactttgagaagccgaggcgggtggattacctgaggtcaggagttcgagaccagcctggccaacatggtgaaaccccatctctactaaaaatacaaaaaattaaccaggcatggtggcaggcacctgtaatcccagctactcaggaggctgaggcaggagaatcgcttgaacccgggaggcggaggttgcattaagcccagatcacgtcactgcactccagcctggtcaagaagaatgaaagttcttctcaaaaaagaaaaaaaatacctataatcaatcaataggcaatatcttcatgaagggccaaattccagaatttttcaacgtattcaaataatgcttccacaaggtttacaaatgtaaaccactgacacttcattccaatctgtccattgccttaatttgcatgaaattaaaagtggccttaagaaatgcagaggagagaacagagaagtgttcacaggagcatttcaaatttgtaaaaaattagattagtcaaccacagcgaaatgattaagataaacttatgaacctctgcaataagaagtcatatgacaatgaatgtattaatttcattgagggtcattttctgccagacaacatggaactgtcattttttcaaaccaagactgctttaagaatacaatttcaagtgtggtcctctgttacagagaggtaaatgttatggatacatagtgctattttgagttgccctggatttgaagtagttaaaaacaatccttattgatgtgatagaaggaaatacaaggatagacgtctagatattcacaactacataaagttgaatttttaaccacatataatctcaacattccacagggatagagtattaaaaattatatctcatctcagtccatctcatctgctcaaataaaggcctattacttcttcatagtgttttgtatgctaagtctaatattaaaaagtgcattgttgtaaattctaattcagcatatccttttcatttggggagataggtaggaacaaggaggatgtggtgtttttgtagctcttcattgcagtaaaacatttaaatactattatttaaaaatgacatagttaatattctcctcaatacttagcatatgtatcttatcttttctagtaaatacagaagaaatattcttcacttcaaagaacctcactgaagctttaatatgactgtaaaatatatataaaaaataaatagaaaattggagacaactatcatgatgggttcatctaacttctacatgagactgtctacatcttgtctattttaaaatgagacaagatacaattagtgattaaaagagtaagcaagtgtcattgtttgcatagatatttctaagactatgataaaatagccatatatgtttgcaagaatttttattgactatgtgaagtcaaatgataagaactgttacacattcccaaggagttttcgtattaattttaatttattctaaaatgaaaagcaataaaacagaaaaatatgtgaacaaatattttcaaaagataaatactaatggatttgtcatggtttctctggcttgacattgagtatttatttctcacatacaattgcttagctaaacatcaagaccaatcaagttgagtgtgtaagacaaacacaaaattggacgcaagggataactaaaattacgattttcccttaggggtttcagttagtaatttttgaattcaaaataatccaatcaaatctacattatatgccagcagtgctctaaagattttaagcatctcagtatgatagaaaacggaataatgtttaactttatcattaattaagacaagagcattttattataaaatggctactttcaaatatccctattcaaaattattcaaaagcttctaatttgaaattagcaggatagatccgtactaagacttttcaaaagctaatcttctattctttcatcacccaatctataattttttacaaagggaaagaaagattataatttttctttaattatgaccatcctgcttgtaataatgacattaattttgtgcttcagagctagacatactgtcttcattgctaagaattaataaaaaactagcatgtttatgatcacataattataggattccaaagtgggaagagggccaattatccaggccaacttctacttttcctagatgaagggatgcaaacaaattttatatctaagcactaatttaggttatatttaaaagtatctctgcttggtttttggcttctatgtctttttctaaactttgcatactcacagaaagcccagttattcaggcagttctttgttctttcttgtgaactggttttcatctcccttttgggggacatgagcctgtagattatctcagcctcttttctaggttcttcctaaagcctaacacaattataaagcaggctctgtcttgtcttcaagctgacaaaaatattttttgagacataatgaaaaattataagaatttcttgaaggtggagtgagaggacgtggagaagaaagagaagaagaaagaaacaggtggaagggaagaagaattcatcacatgagtcatggtgttttcacaagaaaacagagtggcttcatttaccaccaaaatcttttgaatgtctacatctttttagtgtttcaatattatttaaactttaaacgttttgagaattcattctgaatagggtaattattggaatccagaaggatgaaccaactatgctgtagggtactgggacaggcagttagaaaatttgtatttgccaaaggaaagaaaataaaatgaaaggcagaagtcagctgttctggcagggaagatgataatagacaatgcttgtcctgccccagcactgttctaagtgcaatatatatattgcacttagaacatatacatatatacatatataattatattatatattccatatatggaagttatttaatctttataagaagtctatgagatagctaagaggagttcatagagcggaagtagtatacatttcatttcatttaattcagctcttgaacaagttatgataggacatggacatttatatttgttccgattaaatatttcttgttttaaataaaaggctgacttcttaattcttagaataaagaaaataagcaaaattaaacatcaaaaatatttatcatatttgatggagcaatcatcaacatctggcatttagtgtgtgtcttagatactatttttaaactttccattcattgttttttctgccactgccttcatattatttcttaaagtattggggtggaagtttttctgatagcactgcttagttactgcttagaacttagatttattctcctgagtaaactatagacaagttttagttttaactatccaagatgcaaccacataatccagaaatcttgtattgttgagagaatataaaaacctacatttacaaacaatcaaatctactttctaagtagaaaactaatgtgccttgaagagttcttcaatacccatttaaacacttctaagaaagtaaagttatttacttgttttttttctcaagattgattttcttaaatttctctcaaatagcaattgaatggacacacttggaggttttagatttgttctaggctagtttactcttggccttgcaacttttgaatcaatagattgatacttgagtaaatacatttagcaccagttttacatgttaggtcactgttaacaataaattaaacctaaatacaaattttaagggagaaaatcagaaaatgtttaaagaagaccagtttcgaagagaaggtgaaaaagaagaggatgaaggaaactatataaacctttttctatgaataattagcatgatatttgagtaataatactccaagaagaattctgcagtcattgcatgatacatatactatatctccgaagccattgctttaccagaattctagagtatgggtcgggatttgtaattttaacttttaaaatcaaactctatataagtaaattacattctctaatgaagtctttctctcatacttatttttgatattgcaaattctgactcttactcttccttttctccctctcctgctcctgacttcaccttgtttagttttcttcttttcttgaacacatagattctaaagccatttggtcagggttaggtgggcatccacatctggttgggtgacggggagctgtgatggcccagaattatgagagcccaggcaaaatggaaaacaggttcacatgggagagccacctagcatggagtcagagctgagagaggggaaggacttccatgaagaggatgatctagtgcaagtcatatgaagacaacagattgagagaggtatcaatattcaggccagactcagtgatattgtcagtgtctgagactgttgagtagggccttcataccaggattttctgaccatgatgtgttaagtagaatagctgtgcaagagacatgacagtgtggcaatggcaaattatttacatcagggcaattgatcaaataggtacagatattaagaataatgagagaaggtttctcatttacaaacattgaaagggaaaatctagaataaatatcctggtgttgagttagaacattcatgattttagtaaacaagaatagatatacaaataaataaaggttcaaatttgtatgtctctgtgtgtgtacaaataaatatattccttagctctgtttagtcagagggcctagaattagtgacacctcaatacctagcagcacagcacattgatcttggtttctaaatatgtctgattcttggggaaatggctgcttctagactggagaagagaaaagacaaaataagcatggaaacacatgttgagatagaaaataaaaatgtgctcaaaacacaggcgcatgtcaaaaaaacaacaaaaaaatggagtatgtcttaaagaactagagaaatctgggacaatttctgtatcaaagcaaagaatgagaataatatgtcttaattctttgaataaaatagaaatccatgaatccatatttatgcttaataagtaaattgaaagcttcaattttaaatgagaacaaatattgacattatttcaaagagttaattcacaaatgaaaatcctcacagaaaccatcttaggtgatcaaagttaatataaccaataatgggacaaaccaaatcatgtaccacctagtaagatgggatgaaagaaaacagcacctcttctgtgatattcctgataatgatgaataacctcaatgcacttgtgagaaaacatcattaagccaaatcagagatattctacaaaatacctaacttgtaacttataaattatcaggatgatagaaatcagaaaaagaatgagaaaatgtttcagaatgaaagtgcctgcagggacatgacaattaatcacacatgtgattgtgaacaggacttccttttttatttttactacatagttaacattattgacacatttgatgaaaattcaaaggatcttctgataatttgatggcagtaatttatcaatgtcagtttcctgatttgattaatgcattactgttttataggagaaagtctttatgggacatacatagtaaagtattaagggataatgaggcaacagattagacacttattctgaaatggttcagaacaaacattatttttaatttacttgcactttttagattaaaaattatttcaaattaaaatgtatattgtttaaattcagtaagtgacacatggtatcattgcacacacttaattttcattttctcattaaaagccagtttgagcctggcatgatagtgtgtgcctgtagtcccaactacttaggaggctgaggcgggagaatgacttgagcccaggagattgaggcaagtctgggtaacatagtgagaccccatttggatttagtttttataatcaagagttatttgtctttttgtgtgaactttctctttcaaattttcttttattttctcacgagactgttcttcatgtattttcctattagatatgttggcgcattttctgtgatacagttgctataatcatttcctagtttgtcttttgatgttatttttagacatttattaaacttgtatttagtagtatttatcaatattttgactttctgactttgaattttagtaattttggacagtatcaattttttagttataagaaaatttacttaggcttttctttcctttttttttttttttttttgtatataatgagaacatttggacacaggaaggggaacatcacacaccagggcctgttgtggggtgtggggagaggggagggatagcatttggagatatacctaatgtaaaagacgagttaatgggtgcagcacaccaacgtggcacatgtatacatatgtaacaaacctgcacgttgtgcacatgtgccctagaacttaaagtataataaaaaaatacttaggcttttctttatgtacttacatgattttggtttttacatttatatttctgataaatctttaagttactgtgatgtataagatatgaacgcaattttatttttttctgaaaatagatgttcatctttcctcagtatcatttattacaagctcatatttttgcactgatttcaagcatcacttttatcatacataatagtttaatatatgtttagatctcctttctcatctgttctgttgcaacagtacagttatatattcttgagccaacacctcactgtgtttagttataaaggctcattattttaatattataggactgggcctccctgatatttctttttctttttttaattagtcttacttgcttattaatattttttcatatggatttttgaattaagtaatatagctctagaaaaaccatattggatttttttattaaaataatgtcagtcttacaagttaacttagagctttgtcattttatactactaaatcttcatatcttagaacatggtatgcctttccatttattcaagttaacttttgtgcctttcgatgattaggttttcttcatgtggattttagaaaactttgttaaggcctcggtatttgatgtttttattgctcttgtaaatgaagtattctctttcaatatatctttttactagttattgtctcaatatatgcagactcaatatgtgtgtattaattttataaattgctattaaatattaactatgttccttttcagcaggtttctttttcttattgcttgctttaggcttttcatataaattatatcattttgtaaatagagatctttttatttctacattccaaaatattatgtaaattattgctttctcttatctaattgcattggctaatgggagacactcctctgtgtatctcttgggctcatactcctcttactgattgtgctacaaatgcatagtcctgacagctcattacctcggctttctcttggcacttttttgtgttgcagaaagcaactttaaaagatggaagtatcttttcccaggacagagtaggcttgcttatcactactataaaagtagccgattcccaaagcagctcagtttttttcacatacccacagtgtacacggcatccatctggtccacccacatcaccccttgccccactgtgggactcagagggcaaggggaatgggtgaactcaccatatcatgcagcttgctgtgctatagtgacaaagttctgtgtctgtaattcagaagtcatgtatcttttcccaacattcgtaaaatagaagcgtattagcttgtaagtagtataaaatcagatctcagacccaatagttatttcctccaatgcagttttagatactagcagtaccacagaacattttattttactgattttactgggaaagcctcatcaagtacgatttttaattgttgtacacatacacacaaacacaaacacaaattaatcatattaaggaattatctgctgtccatgttcttgagcctttttaaaactcagaatgtgcactttattatacctttcagaatctgtggcattaataataaattttattttattagaattaatataataaattaagttaaaatatttcctcattgaagaagcattcttgcatttttgaggtacattccatttggtatgctttatcacttttaaatgtattgctgaattctatttgctaatattttatttatgattgttgcataggtattcatgagtgaaactggtcttttgttttatttttagtacaatctttatcaggctttagtacctttaaagacagagaaaatcacttcctataatgcagaaaaatattttagacctttatagaatatagtgactaaaagtaaaggtgataatattcagggagtaaattgtgaataaaaagataatgacagtttagaatatgcttactaaaaatgcgtaatgttatatcccttattcagaaatttttgttaaaaatagaagtcacatctctctaatttagggaggaagtacattttaaaagttacttcttgagatcatcctaatatctaagataatataatttgaaatgattgtccctgtggactgaaaaatgaatctttgagacagaaatctgtaccatttaaaagcaaaataccagttcaagggctgtggctcatgctctgtaatcccatcactttaggaggccaatgcaggagaattgcttgagcccaggatttcaagaccatcctggacaacatctctggactgtaacctctgtagatctcatctcaaaaaacaaaaacaaaaacaaaaaacaaaaaacaaaaacctaaaataatactaataaaagcaaagtacttaagacctcagattattttgtcagagctaatattggggtacccatatagcttacacttagcattttatgaaagctccatttttcaccaattattttccagattaaagaaaatgctacaactatatttaaaacctgcttcctatttccctcccatagtttcatcttccttttgtcctggatgttactactcttctgatgttgtgagtgcattcttccttgttttcacctactctgtaacatggctttatctcagtccttcaaaccttccatcatggcacagcagctcatgactcctcctcagccaaatcccctacactctgcattctttctgggtacagctccttcaccttcttgctctaacaattccctggctctcctttgagttcattgctctcccactagaacttttcggtggaggaactcagcatgattagtaactgttcatggactgtgtcctcctggcttctcactgcactttacaggccactcccactccttcctaaaactgtcagctctgaagttcatgccctcaaaccctatcatctgccgtccctctgtactgcagtcattgattctcaatctttcattccctaaaaatgttaattttggctgggtgcggtgcctcacgtctgtaatcgcagcactttgggaggctgaggaggggtgatcacctgaggtcaggagttcaagaccaacctggccaacatggtgaaaccccgtctctacttaaaatacaataattaactgggcatggtggcagacacttgtaaccccagctacttgggaggctgaggcaggagaatcacctgaactcgggaggcagaggttgcagtgagccgagattgcaccaatgcactctagcctgggcaatgagagcaaaactcagtctcaaaaaaaaaagaaaatgttagtgtctattttattttttactttttcaaattaaaaaatatatttgtacaaatttggggggtacacaagcaattttattacatatatataatgattaattatcaaatcagagatgtttactataatcaccactgaagtacaatacatttttgttaagtatagtcaccctactttgctatcaaacattgaatttattcctctgatcttactttatgtttgtaaccttaaacccacttctattcatctctgccaaacaactcactctttccagtctctgataactatttttcaccctatctccatgtgttcaatatttttagcttccacatgtaagtgagaatatatgatagcccttttgcatgtggcttatttcacttaacataatgacctccaattccgtccatgttgctgcaaattgcatgatttcttttattgtgactaaataatattccattgacatatgtaccacattttctgtatctattcatacatcgatgaacacttaggttgattccctttaacatggctccaataataactcttgatgaaaatttgataatctatctactagccaaggcggctttgagtttctcaatgtccttaattttcctcctgacaactcactaactccctaatttgctcccaacattatatcctaatgtcattaccaaaaacctcatctggcacagttccaagcattgtgttcccagtctaccactttatatgttttgaacacaactccaaactgctattaggatttatagtaaaatcattcctattgaattttctttgtctcatcccatgcataccctcattttcttttcttacttttagtccagttttcagtctattttggtcactcctttgcatacacaatcaaaccccttgcttctctcaccctttttaatattggcctagaaacaccccaccctggctaagtccgacctaccgccttggaagtcacttgaattgcctaatgcaactgaaggaacaacacagaataaaatcatgcagtctcatttcaaattcctggttacttaccttaattggtctctcagtagcctagcaatcctacaacatttccttagtttttacattttcccatttccctggatggatttttcataccttgtctttacaggaacacctaacaccccatttctttttctcacttttagctgctgacctagtttcttgttttattgtgaaaagaaatagaagatcattttcaaataccctcagagcacatagatccacttacttttatctgcacccacctagtctatctttctccgtgctattatgaatgaactgtctgcagcctttcatagacagatgtggctacctcttcccttgtgaactaagtcctgtccatttttatgtcctcaattattttccttcagcagttctgtattgtcatctgtctgatcagtttcttcctcacttcttgattgctcttattataataaaactgcaatgcaatatcttatttatttttaaaaatcccttgactcaatatttccctccagctagttcctccttcattcttgcctcttaagagcaaagttacttaagataattttctatactcactgtcccaaattattttttcattgtctcattaacctagtcaaaacaaacgtttgtccccagcaatccacaaaaacaatctcatcaatgacaactatttgtttttctaaattcagtcttacttgacctatcagtaatatttgatagtcttgatcattttattcatcttgaatcattttcttgacttggcttccagggtgccccattccctggcttttctcctgccacactggctgccacttcttttgtttctttgctggtttctcctcatctcagttattaacaagttttagaatgccctctctgggcccagcacttggactcttctccatggaagcttgcaccctctttgatctcattcagtcacattgctttaaacatcatgtgtacactgctgcttcctctatcaggcagaattcaaagaagactgtatcaaacaaacaatgagttaggagaaaatagatttccctacatgctgctcctgtaatcattcccaatcacaattcatgacagttctattcttttccactgctcacaccaaaatactttcagtatttattgaattcactcacttcctcacttcttgtattccatctaggaacaaatattgtcagttctaccttcacagtctctccataatatgagcacatctctttatcttcactgttactaccctaagacaagctacctctatcacttgcctgagtcactacgaaggttactaattaatccctcttgtcttccttccataaattgccctccttcttaacaccaatgtgataactaaatttcgagtcaaattatgccatgctgtgcttacaattcttaaatagctttgaatttctcttctaaaatgtctttgctttgctgcacaagactaaatgacatcatatttcacttatccctctgaaattttcttcttttatataaacttctgttttcaagaaccattattgttgattcattgagagatactctgtttttaactgctgtagagtagatattttatgaatatgcttcatttcagttatccattttcacagtagggatttacatatttccaaatttgtatcacaaattatcaatatattagactcttcactttttgaggtataatcatgaaagtttatcttacttcctttaaacactgctttcaattttcatagatgaaatattttactttccatccttttgtgaaatatccaacagatcccattactttctggtgacttcgaacttctctggccaatgtaaagctttatactcatatccaattcaaaactggtagtgtatctgcttacttttggcactacagcaaataaacatacgctcagtggctttaaaggacatacattattatctcacagttttaaaggtcaaactccatatggactctctgcttcctcttctctggttttataagtccaaaatcaaggcatcagctggccatggcttttttctagatgctctaggggagaatccacttctgacatcatccaggttgttggcaggattcatctccttacaactatagggctgaggtcctgctttccttgctgaagactcttctagctttttaaggccacctgcatctctcatcacactgccccttccatcttcaaaccaaagacagcatttcaggtcctttacacacttcaaatgttcctgtcttccccttatgaaacatgtcttctctagctggagacagttatctgttttcaaagactcatatgatgagatttggtccaccaaggtaatccatgataatctccctattctaacatctgttaccttaatttctgcaaaaacccctttactatgcaatgtaacatattcacaggttcccaggagctgggtgtggactctttaggagggtctgtcattctccttaccacagtcttccctacattgcccaaaggttcatgtctcttccaaatgtaaaatatattcaccccatcccaagatctcaaagttctcatcccattattgcatcaactgaaagtctaaactcccatttaaattcataaattcaaaagtctcaaatctcaccatctaaattattgaaatcagtgggaactgagaatgtgaatataatctgtcctggagcacaattcctcttcatcatggacccatcattctacagaaacaagttgtcttctaccaaaacatgtcctgatttgatttctattttaaaaatatagttgaatgccgcagtaaaactcagaccttcatggctgtgggccatattaacccatcagcaattctagtgctctgagagaaacaatatatttaaatgggtactgggagacaaatatccatgggtcgctcatatttcttcctatatcttgcagtagaggcactttcatcctttgttccaaagtatcttttcatggatatttgtatgttcaacaggtatggaagacagagatagtttctttctctgaagcagaaagcagatttgttatccaatgtaatatgtatatatgtaatgtctccatccacttgggcagatttgattgcacccccttacaaaagctcagggcttctttatcttggggttcttcaactgtgataaaatctcacagtgtgtacagcatcctgctgaacctggcttaccgtcaccttcctggaacttggggcagggggagattgtcaaggagaaccaaagtgaacatgaagctcatgcttcccgctaggctgtgcattataaagtcccctttttctgactaaggagtcttgtatattttgatagcaaactaacagtagctcataagcaaattcaaatctcagacccttacacttcttgtcagattcgacagggaggttgggatgatttcagagacatgactttctagaaaagatggactagagacatttgtgagcttggtgagggaatatgagaagatgacccaggatcctttagtagaatcctgcccatatgatgaacaagggatggcaagaggtaaacgccactgtcctgactatcaaggactattaagaggttgaggggtgagaggtgagattgaaacaagcagtgagattggtgcttcaaatgctgtgcactctcctccagtgggaagaagaaaggttaaggagtcacaaaagttgataacagagctttggatgaaatgaaaacattagaaattcatctggttaaatcaagagtgtctatttcacatctcttgaacttgaaagagccttgctttctggaacagagcttctccttccctccatggccctgatccttccctcctgctttccctgactttagctctgtttcaagttccatttgattgaaagtaaccaaaacccacagggcttatgagaaaagcagagttcattgattcacaaagtttgtaaaggataaggttaaatatggtgacacaataacttagaactggatcctgatagctttacaattatcttcttatctctcctctcttattttaaatcctagataacagctccattctttcataatggttggggccatggttatcagtcccatgtctcacatctttaacatttcaccattagagcaatattgaatttttaattctaggttgagtttgaaaaatttcaaggaaaaatgttcatcaggccaatttgcaacaaagttcaacccacaggattaatcaccttagttgaagaggcaaaaatatatgaccatcacggttttagttttatatccattcctatgatctggggcaggacaacgagccatgatattataataatatgctaagaatattagacatacaaaatgaatagccaatattaattgtttctttaaatgatctgctttatggaatgttaatttttaaaatgacaaaataattaaatattgtataaatatatacacttacaaaagcacaatttttataaaatagagaagtattgaaattgaagtaaacttgttacagaattattttaaaatatgagtagctatttgtattcaaataccaaaaagatttctgataaacactgattttcttcttcaaacatgaaagtcaaatcacatattaaaaatgaaaagaagtatttctgtgtttataatgatctgatcttactctttgtgtaaatatataaatatcaacattcagttacctaaaggtaattatgcatctagtctttaaaaatggaaatggtgggaatatcttcattatttaaaaattactttatatatcaaaaggcaaaattatgagttgaacaattttcttaagcatgggttatcattacggtagggcaaattatcaaaatactttaatcagataaatctttcactcacgattatcaaatatgattttccttgctgcatatccataggccccaaaaccgaataccataatatccacagcagtttggctaccagtgatacacactaagcttttcacatattaatgtctattccatgggcattattccaataaaatatttaataattcaaccaatttaagtattgtttctcctccctcagtatagaaaatccagtttgaaggagacatcaatttatttctcatagaaaacaacattctatggaattaataactaaagatatgagagaacgcatgcacacagatgtgtattaaaaattaatgagtgtttgtagactcaagaaatattaaacttaatttcaactttgtaggcataagcatatgtcagcatatgtcaatttaaaaaattgtccaatttgagttaatacaatatgggccaaagaaataaaacagagaggtctaatacagaattaagacaaataagaattctaagacagaaaccatcttttcaaccctattgaccagcagccatgcctgccagagcatgaggcaaaatttattagaattggtactgaagaacaagaaaatctatcctcaactataatttaaacagacatcatgctaggacaaaaaaccaaacaccgcatgttctcactcataggtgggaattgaacaatgagaacacttggacacaggaaggggaacatcacacactggggcctgctgtggggtggggggaggggggagggatagcattaggagatatacctaatgtaaatgacaagttaatgggtgcagcacaccagcatggcacatgtatacatatgtaacaaacctgcacgttgtgcacatgtaccctagaacttaaagtataataaaaaatatatatatatataaaatgaatagacatcatgaagtaaggagagtccataaaataacaacctttttaattttgatagtttaaatgtatatgtataatatatatatgtacacacacatataagagagacagagaaagagagacaaagacacagagatatgtttatatcttttctgagaaaagcaaaactcttctctctataatagaatctagagggtaaggaagttccaggatctgggagcaagagctattgaagtagtcatatagtcaaaaaacaatcaatatgatttttccagcttgaggtagctttggtgtattgtgttcttcagtattgtccctcattaactcatcctgaaaaagatattttagccatttcagagtttctagggttttgtatttgtgtatatgtcttgtgtatcttgtgtgtcttactatgcatgaactgaagagtttttggaataaataagctctgaaataggattaactttgtcataacatactgcccttactttcaggaggaagaagttaaagctccatgttttgccccaaagggaaaagtgttaaaactgacctttgagtaagtataatggcatttagattattatattatgattaaaatgaactctaatttcagatgtattatgagaccctgacctttttctatattagcagtataatgcttttagaaatggaaaataatagctgtcttgagcttgtaagtgactatccaatatgagatgtcaattgctcgctcattctcttttcacctgggagtacagctggtaacacagtctttattgatctcctagaaaggcaatagatgtaagcacatcaaatacctacttggcattccacttatctggaatgaagagtcatctacaatggcatatctaatacttagaatactatgtgcttgatagaatgtataagcttttattaaatcaattaattaagatgtacttgtccaagcacatgcacataaaattaatatgttcctgctcaagtagttcgtagaaggcaaataggattctttatatgccatacagaacactaactgctgtctgattttaagaaaacttagcaattgccctaacatgtaaattttgaaaagtgacctctttattagggcacaacccttctaggagagaatgtgttggagactagcagcaggaggttgctgtatatcctcttgctctcttatcccagagtctctgctactataacagaataagatcctatagcccttggctctgtaacaaaaattccccaatctgcttcatgggtcctgcattttctttttgggggtttgcaggagcccaataataatacttcttgtttgtttggagtttgcaggagcccagtaaataatagttctctatcttttctaaattatgacattgttgtgacaaaaaatattaagtcaagcaggcataagaaaagcaatcaaacatttattactgataaatatagtcttggaaggtgtggctttttatcagtaggcacttcctggagagtcaggactctgccatcccatgcatagaacagggcaaaatatatgtcctttacagctagtcttgcacccaaaagaaagagaaaaagagaccaaatacccaagatatgcatactcacttctctttccaaagtcaccaatctgatcaaggaagagtgaagagggcagaaagaggagggagtgctaggcgagatgaactccttccatgtggaagaaaacatcagcagagagaaaaatttcttccacttgccccctactaagagagttccccaggttttcaatccactgttctcctccctccatgctacttttctggggtagtcagggctggacccatagttttgcctattatagcaatcaaacaatatacttatagctatcaaacaattacttccaaagctagtttccaacatgagtttcagattcatgtatttaaacgatgacatgataacctgatttggattttttcatcaacattttaaactaaatacatccagaatgaccatcctcatgtgcccttaaaatattttgtcaatttccttctactattcttgccctaattctaaatttcactacacaaaccagaaatttgaagcaggcttgagtcttcctttttctcatgacatgcagtgaaccacgtacaattgatctcatagctcacgtatttgctaatctttatcctctttttattcctactatttaaaccttttgctttttacttaaagggagccaagataacttttgcacttctaggcatcatatgaagatgtcatgaagagtcagaaacggcttttagccaggagcagaacagaatgaaaatcatagacatgcaggatatgtagagtctattcacgaattggtcactcgctgattaatttttgaaaataaaattttccaagcattttttgctattaaataaagttgttggttgaataatatctcaattgtattccagatttaagatgttggattatctgcaggtaaaaggctttgtaattcctgacaaagtacagtagcagaggacaatgaagccaaaaatacaagcaatgagtctagaagcgaccagaacatgttttctcaccttctccatttttcttacagaactataggatgataacatttaaaggaaatttaaagttcagccaccacaagtacttggcagttctaccatattcctgacaagagatcattcattcaacgaatgcctaagtccctagtgataaaggacttaaatatttcctccaatgagagagtcttactgctcccagtttctatctggttgacttattttgggaacaacttaggaatctttcttctacatgaatagtcacataaatattcccatatattaataaaaacagttattacacatctatattgttagttttttgagggacctctgtatcattttccagaatggctgtgctaatttacatttacaccaacagtgtataagattcccttttctccacaccctcaccaaaacttactaccttttgcatttttgataaaagccattctaacaggtgaaatatggtatttcattgtggtcttaatttgtgtttctctgatgattagcaatgttgaggattttttcatgtatccactgggcatttgtatgtcttcttcatgagaatgtggggaatcaaaaacaatttaactaatagaagcagagagtagaatgatgtttatagaggctgcgggtgggagaatggagagatgatgctcaaaaggtacaaaatcctagacaagaggaacatggtgttttttcccccctttttggaggttctattgcccaacttgttgaatatagttaatagtaagagtgctgtaaatttcaaaattgataagagagtaagtttcaaatgttctcattacagaaatgttccatatttgaggtgatgaatgtattaactagtttgatttttaattatttcacatcttgttgattattacttcactttgtatgccataaaaattatataattataaatggtcgattttataataggaacaaagtatcaactggaatgtcacaaaaaataatttaaaaataaaaagagttcaggcccttcctggggcttctctttctaatttaaatgtctcttactttaagatttacacttggcaggtcatgaggtcaggagatcgagaccatcctggctagcatggtaaaaccccgtctctactaaaaatacaaaaaaaattagccaggcgtggtgctgggtgcctgtagtcccagctactcgggaggctaaggcaggagaatcccttgaaactccgggaggcggagtttgcagtgagccaagatcatgccactgcactccagcctgggggacagagcgagactcctcctcaaaaaaaaaaaaaatgatttccacttataaagtaattttatattttcagaaatacaatttgctatttggaagtctttcattttatttaggtgtacattaggacatggcaaaaagaaaaacttaataatttacagttcagtttggtctacccatccatccatccatccatccatccatccatccatccatccatccttcatctatccactccattcatgcacctatcagtctatttgtgtatttttttcattgttcaacaaaatgtttcagatgtgttatcagataggtaagtaggtaggtaggtagatgatagatggatagatagatagatgatagaaaaaaacagagagcagagcaggagtgtcaactcctttgttatttcatgtattctaaacaataaattttatgctattacttctattaattatacacagaaaagtctgtacagaaactgaacgtcaaaagcattgttctctggccatcttctttaataatctagctgtctctattcaacttgtcacaaatctataaggaaaacaaactccaaatgtatatatatacatacacacatgcttattcacatctatcacctatagtcctatcacacattgtggcaaagcccattcaattggttttgctgcacatacatttacataaattttattctattactcgtgtaatattatgctgactttaaaattatgtttttattctaaaatgtgtttatttttaaagctagcattcattgcaaatttacagtatacaagatataatccacaaaagttgcgtgccttttcaatgctcgcatagtctgtatgacacagataagtatagctgatgtaagaagcagcatatcatcattgttaccccgaaatttggagccaaactccacttttcactagctgtgtgaccctgggcaagttacatatcatgtctgttgctttcgtttgttcataggtaaaatagaaaaatacttcaaatgtttgtgaagattaaattgctagtatatctcagaatacttcaaatgcttatgaatatcaaactagctggtatatctaaatgaatattatgaatactaatatttatataaagtaaatattaaattagctagtatatctaaaccctggcatatagttagctacattaaaataaataaatgctctcaagattacaccattacaaggtaagggagctgggaaccagttaagattaacttatttttttaaatgttaaagatatggataaataagcgaagggatttctaaaataaaaaaaaagtaccttaagctgaataatgaaatgtaccaatatgttgatttttattatagtcaaatttacaatccaatcatacacacacttttcaaatcaacttttcctctgaaaccttagtattttgcttaatttataatttacatgttcttttttttcctatattcattctcagttgaaggtaagccggtgcctaccaacacagttcctcttgttccagcagggctagtataattacctactcacatgccactggaaatctcgagcttctagccgagttcggtgaaacacaacctttcatccaattgattccatagtactacaataaggtcatcctaaccattgtcatttcctttactcgacataagtatacatgaaaatctctactccatatattgcactgcaaagaaagctttattgcttcaaaactactcatgtcactttatttgtgggagctacatacaccagaatgcattgcaaaagactttttttttctgaacataatttattcccagaagagcctggctcttagaaggtaaaataattttgtttaataatcaataagagtttaattctgaaaatggctggagaaacttttttgtaatgtttaagtcactgactggggaagggtgggataaacaggtggagggtagcactctgccctaccctagttctctgcagatccatctgggcttttctactcactttcacgaagctgggctgattgttttccaggaatgggcatagcatggtgtggttcccagattgttcttcctatccatcaacttgaaattagtaaatttttttttttttttttgagacggagcctcgctctgtcgcccaggctggagtgcagtggcgatctcggctcactgcaagctccacctcccaggttcacaccattctcctgcctcagcctcccaagtagctgggactacaggcgcccgccaccacgccctgctaatttttttttatatttttattagagatggggtttcaccgtgttagccaggatggtcttgatttcctgacctcatgatccgcccatctcagcctcccaaagtgctggcgtgagccaccgcacccggccaaaagtttttcacaattctggttttagtggttttttttttttcctaagtcttggttttccatatcactgtgaatcttgatcacttcacatctttataggtattttagcgggaagtctgaagaagctaccaagaagacatttcaatatgcacaattctaatttaacattaagatgttttatttcagcaaaaataatatattctgtcagattaataccaataccagcttattttgatggataggtgcattatgcatgtaaaagcaactttaatctataataacaacattagatatcttattgatatgttagtagacattttttctagtatggaaaaatcagagcacaataatatcaaaagaatgttggaagagttctgatagtggaatatgggaacctgcatttttttgaattatactagatttttaaacgttacacttgaaaaaaattaaaaacaagtaaaacaaatactttcacacagaaattatgaaacactgggattaaaactaaaggcactctttcacatgccttccagggtgttccaaccccatgggaaatgcctgcgtctcaaaataataagaacaccttgtgtgagaggttgccatgacagcacatagggcagcaggtgccccattgttctctctctacaaagacttcacagcaatttctcatctctcacttaaaagctactgaccaagatgctgccttgtacaggggctaactctgtgttcaattgcattagcactggaaatcaggagagcaaatggtcagccactggatccacaaacacaattgaatttgatccaaataatgttggcagagctcagtcacaaactgtgaggaaagtgaccaaaattgccacttcacaatcttgaagaatatttacgtagaatacttttctcacaatattcgaataaatgtcaacagacacagagagacttcatttgaaacatggaaatataagcattatctttatctttaaaaattaacatagacatttcaaattattttcaagtttatgtatacagacatttgaacttgaacacacagtttctcttcctatgccttaccatccaatacactttatcttagtccttgatagaaccaactgtgcaactagccattattcatcaaagtgaagtccaatgttgaattattagcaatttgcctaaattgggagacattaggataaaaaagggaatattagatagataaatattagttaataaatttagcaaaaatgagagatttatgagggtgagcagagagaaaggaataaatgactactataagaatagaggactctagaattctttattatgccagtattctttttttctgctcgcaagtttaaaagtgttttatccttgcatgggtactgttatcatgtagagactcacaagtttaaaagtgttttatccttgcatgggtactgttatcatgtagagatattcaaatgatttggaaagcagacatataaattatttagaggacgaaccctgtcaaatgatttggaaagtggacatataaattctttagagggggccccagagctcccatggaagctatcatggacagtaagaccctcactccagcttccaatatttgtaagttaatgataatttggaaaaataaaagtctgctttaaaaattttgaaagtaagtctttacttactttctactcacttatagggctcacttatgggctgtctactcacttatagtaaaatcagaaataaatacttaatattctgatttcccacactcactaaaattactagattttttggagaaactgtgttacattatggacatatgagaatgaaattgaggtaggtagaagaagaggggttttggggttcttgtgtgttttttttaatatgtaagggcaatactctttgatgaagttaaacaaatttcaagtatattcataaaagtgctgcaaattattttgtgtttcatataaagagtcaatgctttgttgaatctttttgggatcatggatctctttgctaatgtcataaaatttatagattgtattctatcaaaaaaacagaatcatcaagcaattttatatgtaatttcatggtttcatagcctatgaagctcatccataaatttcccctgaattctgtgataccaggttaagatgtcctgtaatagaacacatttatagcaaataattcagagtatttcatttgacccaccagtccaaatctgggcagctgttgttgagcctactccctgactcttgtcttacaaacatgtcctcaattctttctcaataataggcaagaaatagaaaactgtttattgccaattgaacatatagtttggtcaaaatgtctgctactgagtccctgggtcttccttcaaattccactgagcagcctcttctctgcacttaccagaaagccatggttgtatcagcatcctattttcgtggccagaactatttggattttaccctatttgcgtaagttcagcaatgtgaagaggagctagaagcagaatctctcctaccaaaataattatatcagctagtaaattacctctaaacattctgtggatgttgacaaaagacaagagactactgtctcagccacagtagactatcactcaggaaaaaacagtagcaagaatatcagcatagtcgcacgtgttttttgtgtcccaactcccacctgatgatgcagtgtgtcaggggagccagtgtatggacagggttcaccacgggaaaaaaaatgggtttatgaaatccactgtcatacatttcctaaatattaatatgatactaagtggtacgttctcctgatgcattatctcacctctcaggttttcatctgcttaaacaatcctgaaaagtggcttgtatgaaagaagctgaggtcatagctttgcaatttttacacactcagaaaaaatgcataggagtgtaagaggttcatggaagactgcctcttaatgataccatgaaataaaaactgctaatagtttgaaaaatttttgacagctcaagcaaatgtttgtattatgtaagaatacacactatagttttttggcctccccatggagtatctcaatagcccagccttttcatgcaatcttcacaggaaggatatcgactctatgcagcttattttaagaactcaggaatggcattacgttgatgacattccccctttctctaagctctcaaggccttacagcttctcccaacatttgcattactctgtgaaccaacatttcctaagtgaccaatgcatacataaaacaatctattcaaactgcaaaatagatcaacaaattttaatatacctcattttaaaatattaccttatatgttttcatattacacattaactctaagctgtaaataattaccacttgtttagttttgctgtgcatcaaagaaactcagccataattatctggtaaggctattaaaatactcctctctttcccaactacctatttgtgaggaaaattttaaaagacctaaataaatggaaaaatatatatttctggattcaaaaacccagtatttttaagatatacattttttttttgagacagagtctctctttgtctcccatgcaggagttcagtggtatgatctcagctcactgcaatctctgcctcttgggttcaagtaattctcatgcctcaacctcctgagtagctaggattacaggtgtgcaccaccacgcctggtcaatttttgtatttttagcagatacagagtttcaccacatttgccagtctgatcttgaactcctgacctcaggtaattcacccacctcagcctcccaaagtgttaggattacaggtgtgagccactgcacctggctgatacattttatttatatattcttatcatataaataagatgaaaatttaacacaattccaatcagaattgttatcagactttttaaataaaagttgacaatctaaatggaacatttccatagtaaagcaaatcatctaaaatagtcaaaaaaatttgaataaagaaaaatctaaagaatctacactatcatactaaaagatgtattataaaaaaaacaattgagccatagtagtactagcataaaaaacagatcaataaaaaaagaggacataaattaacacatatatggtcaatagatttttaataaatatatcattaattttgtgagaaaacgagtcttttttaaaaaataaacaaaatgttacaattacttctaaaagcattttggaagctttttaaatatggaaatgtaagcatgaattaaccatgtactcaactgacattatctgtacattaaatatatactagtcatttgaactacaaattcaaggtatttacacaagagacataaaaacttatatctagacaaaaacttatacataaatattcatagaagctttagtaatatttgccaaaactggaaactccccaaatatccaccaataggtaaatagataagcaaattgtgatatattcgtatattagaatattgttaatgatggcagtggcgggctgtctggagcagctgctgccattgtgccatgactgcagggagggcacagggaggaggcagaactaggcctgcactccacagagctagcaggagccagggacaagcaggagccctccctaaggctgctgccctgggggctgttgccatggggctgagtcaagcagcctgaaggcaggggagcagtgtggtcaggcacagaaggatgggcagagaggggcccagtaaggaccaggatcgtcaccccaggctgcaaggaggtgcagccagggctgcctgcatgctccatggaatgggcaggagccctgccttcccaagtgcaggacccaggcatctctgcaatctgcacccttggggcctgggaaggacccctgctcccgaaggctctggagtgtctgctgctcccactgtctcgcctctccccaatcccggtgcccactctgaccttggagcagggttggggccaagcctgaacactgtcacagcatggctgggtgtgcacacactcagggcagcactgacacaccagcctcctgccacattccccttcagactttaaatgcctacaagcactgggggaagttgaggaggggctgagggcagctcagtgctggcctgcaggtaccccttggcatgagcagcctgggcatcatggagagtagcaggaggcagacaggatcctgggcagaaaaaggtggttccttcaggccagggagggcctcaaggctgggggccaggctgccagtcccacagactggagtgggaacttgtggtgccttttccatgcacacctatggccacccaaggaccaatcagtgcacacttcctcccctctgaagcccataaaagccctaggctcagccagaactgaacactcatcgagatgaccagctgcagagaggagctaccctctctgctaggagctgaacaccctgctgtggaaaggagcttccccctgcaggcctcctctgagctgttctattgctcaataaaacttctcttcatcttgctcactcttcacttgcctgcgtatctcattcttcctggttgcaggacaagaactccggatacgctgaatggcgaggctaaaagagctataaaacaaacagggctgaaacatgcccattgctcaccacattgcaggcgaagagaagaagagaagagctgtggccctttggggagcccagccctgggaactccctgaaccagggttgagattccctgtttggggccccatggtccctggcatctccaagcttctgggcaccaccagattcccccatgccagctgtggaagctgcttgtggcgtgcctggtctggccacagcctcacagagagccagtgcctgtgtcagcacctggagctgcctgcctggctgcagcagccagcatgtctgactgtgtgtagtggctgaaccccacagtcactcacacacccctctctgctccacacctgactcacccttggcaggcatgggatccaagcccttggcaggtgtgggatccaggctgatagtgttagccaagcacagcctgccaggctgagtgggtgaaacaagcccagtggacccaagctttccttgggcaaaggtgctagtggccacagaggtttctgcccagaaaagtgacacctcaaggatcttgtaacattaagtcacaaaaatcaataaactactaatgtaagtaaaatcatgagtaaatctcaaaaacatagataactgctgacttggagaaactagaccaagagagtatatactcagtgatttctttgtatgacattctaaaaatgtcagtgattatctggggtcagcaatagatgatagtttggtgtgaataaccgcaaatctgagcgggaaaacattttgggttgataaaattgttctttacattgtaatggtgcttccatggagttatggactgaattatgttttccagaattcttaggttgaatcaataatccacaatgtgacagtatttggacacagggccactaaagcagtaattaagataacatgaggtcacaagtgtgggtcctgaatacaataggactggtgttcttataagaagaaagtgacacactagcagtgcagtacacagagaaagggctatgtgaggacagcaagaaggtggccatcttaaatccaggaaaagaaccctcaggggaagccaaccttgctgacaccttgaccttagacttccaatcttgactgtagaaaacacatgtctgcagtgtaagccacccagtctgtgctattttgttatggcagccctagctgactaatacgcatggctctaagcatctgccaaaactcatcaaactacacatttaagatgggagcatttcattgaatacaaattatacctcaataaagttgatttataaaacctccttaaggaatgacaaaaagagcactacactgaatgctttatacattaaattgcattccctaaatgagaaacagaacacttgttctctgtttaggatttctacaggatgactataaattcttcaaaagatatagtactctcacaatggcataaatatcctatatctagagtggaaaaattacagtgggcaaagacatctggctttgaaatggttttgttggcagctttggagtgtcagcagaaataagtgacatttctctacagctctggaagcagaagaaaatcacaaatgccattgtcataataggtgcattccttgtgtaaatatgatatactcccagaggatgcctgaagtaattgagagaaattagaggaagctgtagttctagcagagtgaatacagttagagccagaaatagagatttgatttattatcattattttgacttgatgtatttccccacataattgtgccctgggaaaaataagctaatataaaaatagagctagagatagagctggaggttagagacatatatatagtaatatagatagattaatagataaataatagatatagataaatagatggatatatatgaagttatattaatatataggattataaatgcatagatgtataaatatgtagatataaagacagacccaactggtcattttgagagtggatttgtgagtgatttttagctaagcactcatactatacaattaaactataatgctgagtgtgtccttatgggaaacttcaaaattcaaaaaaagggttttaagggggagacaagatgaccaactagacgcaatcaggaagagtatctcccactgagagaacagatcataaagaaggctggcacactccaagcagatcttcagaaggaaagcattgagaataatcagacagaggatgcagacactgggatgaagtgggagaaagctgggaattctgcacagggctgctgagcactaggactagttcctggtctcaagtgtctcctgggaaaggggtgagttaaataggtaggagtggcctagtctcaccacagacttctggaatcctacctgcaggagaccacacaaccacccacagacatctgagctgacaggagagctgcagggagaggtggcagggacaggactccaccctgagcagagcccagcgggtttggcatgggaatagctgcagtgaagcacagccagaatgtctgtctcctaaggcttgccatgctcccccaggtggttttggcctttgatctgtcagactttgacagagcagaacagtcttgccaatataatggggctagtcttatctgagcactgccctgaatgctggcctctcccagagttcctgcctgtctgtacccacttgcagggcagcctcaggtgcccaaccaggctatttcctggcagctaacatcatagctcctttgctggcatactacacttgacaatcaaggagcttcagccaggcacccctcatcaatgcataccaattaacctgcagctttcacccaccacaacttctgcccaccaatttgctggtgcacatgcatccacagcccccacccccaccactttgatggtttatgcacataggcagacctcactgccctgcttctgcttgtgcatgcataaacaactcaccaccctactcctctcagcatgagcacatgcggacaccagcactccatccctgcatgcaccccaccaccccatccccactgacatgtgttaccctgctgcacatttctattgctctcatgaatgttcaagcttgggtcccattgccactgccgcaacaaagtactttggctggtacccttcatcagagtattgttgccagcagattgggaacaccttaacccttccagcacaacaggtgcttaatatcaaggacatagagaacaaagctgtgagcctggtggcaggcccacagggttagagcacacagcgcaggtgtgttgagctgagacttgccccctgaaatcttccctaaatgaaatcagttggccaaactcaccttataccacagtcaaaccctcaagggcatcaaggaatataaaggcaagaaaaaataaaactatccaagagatggcaatttcaaacattcaaacattaaaggaacatcatcagcctatgtagatgagaaaaaaccagctcaagaactctggcaactcaaaaaaccagactgttttcttacctccaaatgaccacactcgctccccagaaatggttctgaaccaggctgaaatggctgaaataacaaacatacaatttagaatctggataggaacaaagatcatcaagattcaggagaaagtcaaaacatatgccaaaatatctcaggaatccaataaaatgacacaagaactgaaagataaaatagccattttaagaaagaaccaaaccatactaatagagctgaaaaaatgcactataagagttttgtaatacaatcagaagtattaacagcagtatagaccaaggtaaggagtggatctcagagctcaaagacaggttattcaaatgaactcagataaaaataaagaaataataattacaaggatgaaaaaatcttctgagaaatacgagattgtgaaaagagaccaaacctatgaatcattggcatccttcaaacatgagaggaaagagcaagcaattagaaaatatttgagagtattgttcatgaaaatttctccaattcactagagaggtcagcattcaaatttaggaaatgcaaagaagctctaagaaataatacataagacaggcattgccaagatacatagtcattagattctccaaggacgatgtcaaagaaaaaatattaaaggaagctagagagaaagggcagaacacctacaaagggaagcccaaaaggttaacagcacatctttcagcagaaaccctacaagcaagaagagattgaaggcctatttttaacattcttaagaaaagaaattccaaacaagaatttcacatccagctaaactaaatgaagggaaaataagattctttacagataagaaaatgctaagagaatttgttaccataagacctaacttacaagtagttcttaatggagtgctaaacgtggaaatgaaaggccattatcagtcaccaaagaaacacacacacacacacacacacacacacttatgcacatagaccattatgatggttaatactgaatgtcaacttgattggattgaaggatgcaaagtattgttcctgggtatgtctgtgggggtgttaccaaaggagattaacatttgagtcagtggattgggagaggcagattcaccctcaatctgggtggacaccatcaaatcagcttccaatgtggctagaataaagcaggcaggagttggaaagaacagacctgctgagtttcttggccttcatttttctcctgtgctggatgcttcctgccctccaacattggactccaagttcttcagctttcagacccttggacttacaccagtggtttgccatgggctctcgggccttcagccacagactgcaggctgcactgctggcttccttacttttgaggttttgggactcagattggcttcctcgttcctcagctttcaaatggcctattatgggaattcaccttatgatcgtgtgagtcaatactctttaataaactcccttttatatatacatatatcctattagttctgtccctctggagaacacttagtagtacaactattgacactaaaaagcaattacacaatcaggtctgcaaaataaccacctaacaacacaaagataggaccaaatctgaacgtatcaatattaaccttgaaagtagatgagctaaatgccccacttaaaagacacagcatgggagaaagatgtaggctgggaggctaggcccatctctatttttcatgtttttctgcctgttttatatttgctggcagctgattagattgtgcccaccagattaagggtggatctgccttccccagcccactgactcaaatgttaatctcttttggtcaacacccacatagacacacccaggattaacactctgcatccttcaatccaatcaaattgacagtattaaccctgcaagtccacccctacatctcctgagatcatacgtactcttcaaataaagacaatattgaggtcataattatgcttaacataaaaacaactatccttcatacaaggggaaatgcactaatccccaacccaaatactattacataaagttaacaatacttaaatgctgatatgaagtcaataaatcttatgtcacatgataaaggaaaaggaaataacatgaagatatttccttagtacaagtgtatacatgcacaaacatgttttcaacaaaagaaggaggaaatactcatgacaattacagttctcatttccgcagccggtcatgtggtcatagctggtactgatgactaccttcttctactacccattctgtatcccctttgccttcagcaagcacctcagcaggtcatggttttcttcctggtggagtgacccaaaccttcattcctgaagagtctggaacatttgtagtcctgcctggatttggctgttgtactttcccattgaccttaatatccactcccatgcctgttctccagattgctgtttatataaattagagaactcaaacagttctttttgaatgtagtgcatttcctcatgggtcacactgtcaacctcacctctggggacccaccaggactttagtctagttacaggtctagaagcaaacagaggtgttcggtgtgacttctgaggagaatcaacattatcttgcctggcaattgcctttggagagggcatcactgttgcctcaggcagtgcagggtttttctcctcagacaaaggtggaaaggctgatggcagcatgagtcagggaggggatgttgccactactggggatggggatgttccttctggcaaagatgattcatcagagtttacaaactcagtatctgcagcttcatcagggtcctcccacatatccccattccaagttgcagggtcccattcttttccaatgaatgccctcactttaacagtagacacctggtgatgctgtgcatgcatctttcgttcaggtcagccactctcataataagagtttgtttctttttccacaaatccatctctttctcttcaggagattagactctcactcagggcaatcttagcagatttgaggctcagtatctgcttctgaagccttgagacagaatccttgagttcatcattttctttcatcactttgtccattgaaattagaagcaaccaaccagcttcattatgtctcttggttctccacaaatggtcaaaggtattatgtacagagtcactaaattctttgcccctcatgagcagtgaaacaggagtgtcaaatgcattattgtgcataactctctaagcagttcatgccaaggagtatcaatgttctccatactaacaataatgagaacaaagacataatatatcagaatttctgggacacaactaaagttggattatgaaggaaatttatagcactaatgcccacatcaaaaagttagaaaggtataaaattgacaaactaatatcacacctaaaggaattagaaaaagaagagcaaaccggcaaaccaactccaaagctagcagaagaaaataaccaaattgtagctggatttaatgaaattgggatgtgaaaaaccacataaaagaacaatgaaactaaaagttgcttccctgaaagaataaaattgatggaccactggctaaactaataaagagaaaaagaaagaaaatcgaaataaacacaatcagaaatgacaaaggggacattaccatcaacattacagaaatacaaaagaaaacaacccctcagagactattatgaacacctctatgcacagaaactagaaaacctagaggaaatgggtaaattcctggaaacacacaacctcccaagattgaaccagaaagaaattgaaactctaaacagaccaataattagctccaaaattgactaagtaagaaaaagccagaaaaaaaaccctgtactagacagattcaaactgaattccaccaaacatatgaagaagaattagtaccaataatattgaaacttttccaaaaacttgaggagtagggactctgccttaactcagtctctgaggacagcattattcagataccagaatctagcagaaaaacaacaacaacaaaacttcaggccaacatacctcgtgaaaatagatgcaaaaatcctcaacaaaatactagcaacccaaatccaggagcacagcaaaaagctaatccttcacagtcaagtaggctgtactcctgggatgcaagattgattcaacataaacagaactaaaaacaaacaccacataattatctcaacagatgcagaaaagactttcaacaaaattcaatatattaatgctaaacaccctcgataaagtaggtattgaaggaacataccacaaaatagtaagagccatctatgacaaacccacaatcaatatcataccaaacatgcaaaaggagcaagcattcttcttgagaactggaacatgacaaggatccacactgttaccactcctattcaacatagtactggaaggctttctcagagcaattaaacaagaggaagaaataaaaggccttcaaatagaaagagaaagagagaaagtcaaaatatatctctttgcagataatataatctctggaatacctaaaaaccgcatagtctctgctcaaaagcttctaaatctgataaactatttcagtaaacattcaggatacaaaatcaatgtataaatatcagtagcatttctatacactgaccacatccaatctgagaaccaaatcaataatgcaatctcatttatattagacccccaaaacataaaatacctagaaacacatctaaacagggaatgaaagagctctacaacaaaatttataaaatactgcagaaagaaatcaaagacaacacaaacaaataaaaaaacattccatgctcacagataagaagaatcaacattgttaaatggctgtggtgtccaaagcaatttatagattaaatgatatttccctcaaactaccaaggacattttacaaagaataagaaaaaactattctaagtttcatatggaaccaaaaaagagcccctagagccaaagcaatcctaaataaaaagaacaaagccaaaggcatcacatgacccaacttcaaactctactccaaggctacagtaactaaaacagcatggtacttgtataaaatataaataaaaatagacacatagataaatggaacagattagataacccaataataaagccacacatctgcaattacctgatctttgatgaaatcaacaaaaacaagtaatgaggaaaggactccctattcaagaaatgatggtgagataactcactagctatataaagaagactgaaacggaaacctttattttcactgtatacaaaaatcaactcaagatggattaaagacaaatgtaaatctgaaactataaacgctctagaagataacataggaaataccattctggacataggtcctgatggaaattttatgaaaaagacaccaaaagcaattgcaacaaaaacaaaaattgacaaatgggatctaagagcttctgcacaacaaaagaaactatcaacaagtaaacagacaacctacagaatgagagaaaatatttgcaaactatgcatctggcaaaagtctaatatccagaatttatataaaacataaatcaacaagcaaatagtgaacaactccattaaaatatgaagaaaaagacatgaacagatactttgcaaaggaagacatacatccagccgacaagcatatgaaaaactgttcaatatcactaatcactagagaaatgcaaatcaaaaccacaatgaaataccatcttacaccactcagggtagttactatcaaaaagtcaaaaaatagcggatactggtgaggctttgaaggaaagggaacatttaaacattgcttctggaatgtaaaccagttcaaccactgcggaatgcaatttggagatttctcaaagtacttaaaacagagctactattcaatccagcaatcctattactaggtatataaaaggaaaataaattgttctcccataaagacacatgcacacgtatggtctaccatcaagacacatgcacacactattcctaatagcaaagacatgaaatcaacagtaaatgcccatgaagtgtgtgctggataaagaaaatgtggtacatatacaccacaggatgctacaaaggcataaaaaaagaatgagaacatgttctttgaagcagcatagatggagctggagcccatcatcctaaggaaattaatgcaggaatcaaaaaccaaatacctataattgggagctaaacatggagtactcatgaacataaagagggtagcaatagataccagggcctccttgagggtggaagttgggaggagggtaaggatcaacaagctacctattgattactatgcttattacctgggtgatgaaataatttgtacactaaacctccatggcacacaatttatccatgtaacaaaactgcacatgtaccccttgaatccaaaataaaaattggaagaaaaaaatcaaagatccagtatcttctaaaaaacatatctttccactccgtattctaaaaaccatatttctctactccatattgagtagagttaattgaataagttaattgagtaatttacagtgttgcatgtttttttattaagactttttcttgggcttttcaatttgagacatactatattaaaactagtaattcaatgtaagatctgtatatttctaactatatttatctcttttacagtgttataagacttttaaaactatcacatctgtcctacattagccacattttactcttacattgctagtaaaacaacgctacttaatggtaatctgaattatttctaaagctttccagggttcttcccattatttctttttttttttttttttggttgtttgtttagacagggtctcactttgttgcccagtctggagtgcagtggcatgatctcggttcactgaagccttgacctcccaggttcaagcgatcctcctgcttcagcctacaaaccagctaggactacaagcatgcaccaacatgcccacctaattttttgtatttttagtagagatgaggccttactatgttgcctgggccaggcttgaactgtggagttcaagtgattcacccacctaggcctcccaaagtgctagggttacaggcatgagctgctgtgcccaggctctattatttctgtaaccactagtcttccttttcctgaattcctttgtgatttggagggattaatctcattattatattccctttttaatagatatactcagattcactaattctgtaaaggctaatatttaagtaatcataaatataaatgccctttatattattaagatattcctaatcaccgactagaaaaagttgcaaaaaagtatagagtccatattgcaaatactatagaccttaaaatgtaaaaattctggtcactggatatcattagaacttaaataaatttacaagaaacaaacaaacagccccataaaaaagtgggcaaaggacatgaacagacacttttcaaaaacagacatacacatatgtcaacaatcatatggaaaaaagctcaacaccactgatcattaaggaaatgcaaatcaaaagcacaatgagataccatctcacaccagtcagaatggtgattattaaaaaggcaaaaaataacagatactggcaaggttgtggagaaaaaggaatacttgtacactgttagtagaagtataaagtagttcagccattgaggaaaacaagtggtccgcaaagaccattttacccagcagtcccattactgggtatatacccaaagaaatataaattattctattataaagacacatgcacacatacattaattgtagtactattcacaatagcaaagacatggaatccacctaaatgcccatcaataatagactgcatagagaaaatgtggtacatatacatcatggaatattatgcagccatgaaaaagaataaaatcatctcattttcagggacatggatggagctgtaggccaatatccttagcaaactaacacagggagagaaaaccaactatctcatgttttcactcgtaagtagtacctaaatgatgagaatatgtgaacacctagaagggaacaatacacactggggtctctaaaaggttggaggttgggaggagagagaagattaggaaaataactaatgcatgctaggcttaataccttggggatgaaatatgaaaacaacccccttgacaaaagtaacctatgtaacaaacatgcacttgtacccctgaacttaaaagttaaaaaaaaagaagttagacaaaggaaagaaggcaactgggaagtttttcatatttaaaaaaaatgagaaaaagaaagtctacttcttaaacttatggagcagaaatagtggtttacaactggaaattaatgtttaaaagaaaactgatagagactttaaaaataacaaatcttgaaagaggataaaggaaggtgaagatattgaggtaatttttttcttttatagcaggggaaaataaatatttatgttgataaatttaaaaatatatgtataaaaatattaattacaattacagactcaaccatttgtaagaatgcaaatgtacaggggtagatatctctaaaattgagttttgtagtttgatatggtttggctctgtgtccccacccaaatctcattttgtagctcccataattcccaaatgttgtgggagggacccagtggaaaataattgaatcatgggggtgggtctttcctgtgctgttctcctgagagttaataactctcacaagatctggtggttttaaaaatgagaatttctctgcacaagcactctctctctttggctgctccatccatgtaagacgtgacttgctcctccttgcctttgttatgattgtgatgccctcccagccatgtggaactgtgagtctattaaacctctttcttttataaattgcccattcttggatgtgtctttatcagcaatgtgaaaatgggctaacaaagtaaattggtaccagtagagtggggcactgctcaaaagatacccaaaaatgtggaagtgactttggaacagggtaacaaacagaggttggaacagtttggagggctcagaagatagaaaaatgtgggaaagtttggaaccccctagagactggctgaatggctttgcccaaaattctgacagtaatatggacaatagaggccaggctgaggtggtctcagatggaaatgaggaacttgttgggaactggagcaaaggtgactcttgttatgttttagcaaaagactggtggcatttcacctctcccctagagttctgtggaattttgaacttgagagagataatttagggtatttggcagaagaaattcctaagcagcaaagcattcaagatgtgacgtgggtgctgttaaaggcattcagttctataagggaaacagagcacaaaaggtcagaaaatttgaagcctgacaatgcaatagaaaagaaaatcccattttctgagaagaaattcaagcctgctgcaggaatttgctgaggtaatgaggagccaactgttatgccccaaggcaattgggtaaatgtctccagggcattatcagaggaccctcccatcatagtcctggaggcctaggaagaaaaagtggttttgtggtccgggaccaaggtccccgtgctgtgtgcagcctaaggacttggtgtgctgtgtgcagcctagggaattggtgccctgtgtcccagctgcttcgccatggctgaaaagcaccaatttagagcttggtccatggcttcagagggtgcaagccccaagcttggcagcttccatgtggtgttgagcctatgagtgcacagaagttaagaattgaggtttgggatcctccgcctagatttcagaaggtatatggaaatgcctggatgcccaagcagaagtttgctgtaggggcagggtcctcatggagaacttctgctgtggcagcacagaaaggaaatgtaggcttggagtccccacacagagtccctactggggcactgcctagtggagctgtgagaagaaggccccgtcctccaaaccccagaatggtacatccactgacaacttgcaccgtgtgtctggaaaagccacagaccctcaatgctagtccatgaaagcagctgggaaggaggctgtaccctgcaaagccacaggagtggaggtgcccaagaccatggaaacccatctcttgcatcagcatcaccttgatgtgagagtcaaaggagatcattttagaactttaagatttgactggactgctggattttggactttcatggggcctctagcccctctgttttggccagtttctcccatttggaacagctatatttacccaatgcctgtacccccatcgtatctaagaagtaactaacttgcttttgattttacaggttcataggtgagagggatttgtcttgtttcagatgagactttggactgtggacttttgagttaatgctgaaatgagttgagactttgggggactgttgaaaggcatgatttgtttttaaatgtgaagacatgagatttgggagggaccagagtcagaatgatatggtttggctctgtgacccacccaaatctcatcttgtagctcccataattcccacgtgttgtaagaggaacctggtgggagataattgaatcataagggtgggtctttcccatgctgttctcttgatagtgaataagtcccacaagatctgatggttttaaaaatgagtttccgtgcacaagctctctctctttgcctgctgccatccacgtaagacgtgactttctcctccttccttctgccatgattgtgaagcctcccagccatgtggagctgtgagtccattaaacctctttctttggtaaattgcccaggctccagtatatatttatcagcaatgggaaaatggacaaatcacagttgcaactgaggttttcaaaaaatatattttacttgaaaatttgatagtattaaaaatttcttaaatgttttaatttattatagtaatattagacacttcttttaaaataagattagacattttattagatatcacacaactgaattccttccttctaatttctgggaaaatagataaatatatttcaagaaaacttatattaggtatttttctaatgcattttgtttgagtatgggcttagctttaatcagacattatttattgttgttccaaactgattatagtatttataatactcacctttgatgaaagaaaactttacactgtattctttttatgaaaaaaattccgagtgttttggaaagaaggctacaaaaataggtacctacgtagttatactttggaaacagaaaaatttcactggtctcctctctcccagtttcaaacacacaaatttttaaaatgtgtttccaggtgatagtaataatgatataaaataataattctcactgattttcaaggagatctgaatttttatgtaggtgataattgtagctctgatttatctatttctataaataaatgcatacatattttatgtatcattccatacatcatacataagacattctggtaattttgctggaattttttgaaaaagaaatcactgaaaatgtttgtgctggtttcatatacatgtttgtagttatacatatagaattcatacttacatgtttaagttatagattaaaataattttaatactttcatctacttagtaatctctgaaggtattctcaagtatattacaagacaaaatcaattccaacagattcaatatttgattagatttcttaggtattactatatttcacttaaagacattgttaataatgatgtattttattaaatctaatttaatattctatgttgcaaaatcagcaggaattcaaatgaaaaataatggtaaaagatcatttaaattcacaatcaatttaattcattaattgatctgataaagctgctctctcattctctgttataacaaaaatattaacatttctttgacaaacaaaaatcaattttcatttgcagcaggagctacatcttattttacagaacaaacacacattcagtgtgaataagtagtagtaaaaatgagcctggtatctggaaattactacttagcttactgctcttttatgtgtgtatttttttcctgactgagaacatagtttaattgctctataaaatttagagggttcaaaaaattgcaataaaattaaatgagataaaaatgtatgctaactaaagtgccattgcattgcactatatttttgttttgctttatatttagagaggtgaaataaaagggtcagacccattaaagttttatagcaactcaaatccaagttgacacagtgtttttttataagttttaaaaattccctagactcagtaaaatgtgaatcaaatttaagaaaacagagaaatgggaaagcagaagtttcaaaaaaggctgggttgaatcccgtcctcacaggaggagaggttgctaaatttctcatcagttgtggttctcagcttttttccattttgtaatataagataaaatctgtgaaactttgagattatcttttcaaaaaggcagctaaattttttataaaaataaagacgggccaggcgccgtggctcatgcctgtaatcccagcactttgggaggccgaggcgggcggatcatgagatcaggatatcgagaccatcctggctaacacggtgaaatcccgtctctactaaaaacatacaaaaaaattagcctggcatggtggcaggcacctgtagtcccagatactcgggaggctgaggcaggagaatggcgtgaacccaggaggcagagcttgcagtgagcagagaatgcgccactgcactccagcctgggcaatagagtgagactctgtctcaaaataataataataataataataataataacaaaataaaagatgatgataatgaattaaagttgttgacaaaaaagagtcaaactctgtaaaatatttgaaaggattaattctaacgcaaatgagttaccaaggcttgaggaacagtctcaagaggttctgagaatatgtgcccaaggtggttggcatacagcttgatttgtatatatttgaaagggacagaagttataggcagacatcaatcaatacatgtaaggtgtacaatggtctgtccagaaaggcaggacaacttgcagtggaagcttccaggtcatagctacattcaaagattttctgattgccaattggttgaaagagttaagttattatctaaagacctggaattaataaaaagaaataacgagtttaagataagggattgtagagaccaaggttctcattatgtagataaaggcttcaggtaacagacttcagagagaatagatggttaaaaaactcccagtgtagggatattgcattaagggggataccacagttttgtatcttttacttctgggagcccgtttatattttcaaagaaaaattccccagtgtttctggcagaaagaggactaaaagtggtcattttgaaaaaagtacaaagccttctcttctccttagcaaaccctgcatttatcataaactatgttgccaaagtctaacccacatggacattaccagagcttaactgacttgagggaaggaaaatacgcaatttcagacccttccaatccttctgtctcatctcagggtggtggagatgcgtagaaggagttgcaaaggtcacattccaagagccaattatcactaacagactgaattatcactaatcataggactacagaacactgcctttccttctacaccaataaagctctggaataataacgggattacaaggcaaagaactgcaagtctcagatactactaaataggggtctctaggggaaaccaaagccaacaggagaggtaaaaagaaaaacattagaggaaagttttagcctctgctattaacagataaaataaacagtaaacacagcataaccactagctaaataaaaataaaattacacattaatgtcctctttaattcagttcctttctcctgatatgtcatgttcagctatcaacaaaaaattacaaggcatgctaaaagacaaaaacacagtttaaacagacaaatcaagagtcagaatcatatttcaatatagcagagactttgtaattataagaccacaagtttaaaataattgtctttaatatactaaaagatatcatggaaaaagcagacaccatgcaagaatgtagaggtaatataaatattattggtgatttttgcctccaataaacctaagaaaaaagtaaaaggaaataatagaattcaaaagcaatgtacagaaatgaaggatggctttgatggactcatcagtagaattgtcacagctgaagaaagaatcagtgagcttcaaaatatgttaatagaaatttcccaaactgaaaagcaaagagagaaaagaataaaagaaaaatgaaatagaaaatccaagacctatgggataattacaaaagttgtaatatatgcataatgggaatagcagagaaaaggaaagagaaaaaggaacagaaaatatttgtggcaataatggctgagaatttcccaaaattgttgacagatacaaaacagcagatacaagaagctcggaaaacatcaaacattatacataataggcgaagattgaagattgggaaagaggcacggatgtctactctcactgctgttattccacatagtgctagaaattcaagccaatgcaatgagaaaggaaaaagaaaaggcgtataaatcaaataagaaaaagtaaaactgcccctatttgcagatgacattgcagtttgctgttttggaaatcccaaggattctaccaaaagaaacctagagtgaatgtttgagttcaggaaggtcatggaacacaagataaacataaaaaatgttatctactagtgataaagacatatgcacaacaattaaaaataaaaatcaatttattagcactcattacaatatgtttggtataaatataacaaagcatgcacatgatctatatgctgaaaattatacaacactgatgaaagagatcaaagacccaaacaaatggagagacatattatgctcacaggttggaaaattcaacacagtaaaggtgtcagttcgtcccataatgaaatgtaggttaaacaccattcttatcaaaatcctagcaagattttttttgtaaatatgtccaagattattctaaaatttacatggaaaagcaagggaattagaatagttaatgttgaaaacgaagagaataaattggagggaactgataactggactttaacatttatcacctagctacagttatcaagtctgattgtaccggcagagaaatagacaagaaatcagtggaatggaacacagaactgagatatagaatcgcaaatatgctcaactggcctgcagaaaagttgcaaaatcaattcaatggagaaaagacaatcttttcaagaattgtcttcattgataaggttctgagtggaaaatacacagttaattatgacattgggtcttacacattcctatggaactgactctctacaagaaagtaggagtggtgctggcagcacaaaatgtgataagtagtttcactgagtagattttcctatctgccacaaacacttagtaggtgttggaagaactgagttatatgtgttaggatatggcttgagtgggttttacagaatgaacattgaatggcattctgaaaagctgggaggccatgtaacccatgtaagacacaaatgtcagtacatggaatcctgtaggaataatattgaatgaagtgaatggacattttaagcaggtgatatcgcgagttctcagtatttaggaagtctacaaattactcttcaatatacttagaacatttttttagaataaaatataatatgttgaaggaatatttcttaacattccacataatctcaggaattctggtaaaagaaaattcaaggctacttgaaaatacttcataaaaataatttcctgggaaatatttatataatagacatataaatattttacataattttatagggaatgaaaattgcaaaggtcttcattattttatcctcagttttacattccaaattcctggaattatcaaagatactgggtcagaacctataaattttatgtagtttaaacacaagacatattatgtacaacatggttaaaaaatatctttatagatcagcccatggattttgtctgtggccctaagcagtatgcctaatgaattttcttgtaacagagtaagctgtatagtaattttgaaattctattgaaataaatgtactgaaggagtatttcttgaattcccttggcattaagttcctgaaaaattatatttttgcattttcaattgtgacttatgctgtgatttaaattataatataaaattcatctacttggttttattttcttggagctataaactagaatatgctacaaaagtaaattgaattaagttggaaaatatggttagattctcattagtttaaaacttttagttttcactttgtgccagctatttgttcttggtgacattctgcatacaatacaatcatgtcaacagctaaatatacttaaattcaaatgatacccccattaagaattaggaatgttgtcatttcaatgtttcaaattgttctaaaatgtgatattaaaaaatgaaaaatcatgttctgaattaaaaatgtaatgatctgaatcgcaatggatatgttgtatttggtctatatggaatttttcagttttatgtgaagaattttaattgttctaaattatcttccaggtttatattagatttccgtaaataattgtaaatatttttagaaagttgtttgcatttaaagtacaaaagagcatgcaaaattatttagaaaataatagaattatttaaattttcattataaaaattgtggaaatcgtgggaataaggagtagaaagaaagaaaggagaatgtagctgaggcagtaacagcaataaaggtgacacagactttgttcttatcaagtttatatgctacaggcagtaaataagcaaaaagtgtaattttgtatagcaataaacctcatgaagtagacaaaagaggataatagatggaggtgacatataagctgcaacctaaatgacaataaacaaatgccaggtaatttggggaaagagttttcaaggtagatgggatagcaaattcaaaggccatgaggtgggcacaagcaaatgtggtttaaacggtggacctgaagtacacagatataagataaattccaaaatgcaggcaggggccagatcattggctctaaaatgatgagtttgtattgtatttcaattactctgcaaagcgagtataatcaaaattttatcatggcctgatttacatgctaaaaggatttctcctgctgctgcctggaaaatgcattgtaaggaggggcaaatttgaaatctggaaaaccagttaggaagtaagtaattgcagtagtctaaacaagaagggaagggatttctatatagaagagaaaatagggcggccgtagactacctaaggcataatttgacatcatttatcagaaaaatacaacaattactatttttaagtacaacttcagatattaaagttctaaaataccatacattgaattgactgaatccagttatctaatccagttatttggattttatgaattttagatgtttataatataaaaaacttatgaaccttctatcttgatgcataggataagattaaaattgtatgtctgcttgtttttgccctagtctcttctttcaagtcctagtgaatcaaagttcctagatcattgtaacctccatgacaacaaaattgtgcccattaaatgcacacagttttagtacatagagcaatgtgttttcagggtgctttatgtcataaaggataactgagagttgttctatatgaggacaaagcacactatcgagagtatatcatcattggaaatatagtttaagggacaaaaaggaaattatgatgaatactaaacttctctttgaagtgcctcatgctaatctacactttaattgtatgctctggttccctacatccacatggggaaaagtattttattgactctgcttgccaaatatgtttgggatgccatagaaaataagctgacattacaggatatattgtgacttcaattactaaaggaatcatgagtctatttttaagactagaaattttctcttattgaaaggaagaaattagaaagaaagcagttaagcggttttgtacaggtcatatcccaagctagttggatatttggtaatagaatcccaacaactgaaacttgaaattcatcaccagaagatcatgttctcttttaaaataaactaaaaaatcttcaaatgatatatattattagctctcttactacatctttcctttgtttttaatcaatgttattgaggtgtaatttacatacaagaaaatacagccagtttagttgtgcagatcaatgaatttctagcaatattatcaccacaatcaattatagaacaattccatcaccaccaaagtttcctactgacccccgtagtaaattctcccttaccaccggtcttagacaattacttatttactttctgtaaatatagattggttttatcttttttagaatttcatataaaaggaaagctatagattatatagttttcttcatctgttttccttcactcagcatattgcttttaatatttattcatattattgtgtgtatcagccagtactgcacgtttttatattgccgagcagttctctcatacatgattgtaccaacatttttatccattcagttgttgcgcatttgagttatggccacttttgccagctttatacataaagttgcaaagaacaatcatttataagtatttgtgtggacatgcgccatcatggatcttgagcaaatacctaggtgtggagtccttgtattatatgctgaatttatgtttaactttataagaactgttaaaatattatacagcgttgtgctcctgctaaaaatatgttgaagttccagttgctctacatttttatcaatacttggtattgctagtgttttttagttttagccagtgtactgggtgtgaacttgtaccatatttttggttgcagttccctgatgatatagaatatctttgcatatgcttattggctgatttgtacatctgtttttaaagcatatgtttaaatatttttcctcttgaaatggaattcttaggattgaattgtaaggattctctgtatattcttgatacaagttatttgtcagatatataaattatgaatttttttctaatttgtaacttgccttctgcctttcatattaaaaggtaacatttaaagatgtttataattgtgataaaatccaattagtttttattttacagttcattctatgacatttttgctagccatatttaaaatttttttgctagcttacagttgtaaagtttttctcctatggttttttctagaaatgtaaaaagtttatctcttacatttacatctatgattcatttcatgagaaacttgtatattatttgagagaagggtagaggtttacttttaaattatgatgatgttctagtactatttccttaaatattatttttcaaccattacattttcttgctgcctttgttgaaaatcaatcaactttatatgtgttggtatatttctggactctctattctgttacagtgatctatatgtctatccttatgtcaatgccaaactgcatttattacagtaactttgtacctaatctcgaaaaccatgcaatttaagtcattcaactttgttcttctttgaaatcatttgtgctcttctagtttccattgtgtgatcacatatttttaaataagtttgcttgtttctatgaaaactttttactggattttaattggcattgcattgaatctctaagtcaatttgggaagaattgataccttaacaatactgagtcatcgaatccatgaatgtggcatattttcagatttctaggtcttcataaatttctctcagcaaagctttgtagttttatatgcacaggtgtggtggatattttgttaaatttatctttaagaattttatgttcttgatgccattgtaagcctttttaatgtaagccttttcatcttccaggttattaatgctagcatatatataaattaaaaataaacttgtgtatcgagtttgtattttgtgcccttcttgaatttgcttcactgttctagtttcttttgtgtacatttgttagaatttctatgcatagaattatagatatacttacctatttttttctaatttttacaaattttatttctttttatgacctattgcactgtacctccaagattccgttggaaatagagaaagtgtatatcctttcctttttttcaatcttatgatgaaagtattcattcattcccccattaagtatgttggcaagagtgagattgttgtggatatcctttttcaggctgactctgttctttattttctaagtttattgttattgatggttttaaatgaataacattatattctacatttattcaaactagcatatatttttacctcttttttatattaacatggtcaattaatttcttgaaggttaaaccaagcttacattcctatgacaaaccacatgtatcatttttttgaaataattgtaattaatttcaattgattccttagtatattttaagcaaatatgcattttaaatcatgagaaatattgttatgcaacttaatttccttttaacacattcctcagtttcagtagtaggtaaacactgactgcaaacagaaaatgacttttttctgtttttttcctctattcttggaagtttgtctaagattaataccttttatcacttaaagatttgatagaattagaatctaccagataaatcatctgtacctagagattacttgtggtaatagagcccatggcaggaatggggtgagcatcctgggtgcaggcagctgagagctcacatggtaaaggatgtctgccaccttcccagccacactggggtgctgaagaccagagacagcaccacagtggaacacaaatgggtgagaaccaacccatgggtccacatacatgcaacttaaattcaaaagtaggtgatgaatcatgggtattcagagccctgaacttatcctggtgtgaaacatgaaggagaatcaccaaaatcagacagccaaaatcagcctgtcagtaccattctggcagtctagtgtcaaacaatcccataaaacaaataactacacgggatagcaagagtggtctgtttacatgaatgccctcctggaattgagttgcttatggcataaggtcaattatggaagcagagatgaagatgctgagacaggaacgctgggacccatgtctgatgaggtccagtgaagccaggttcagattcagtgcattctgcccaaatgacactgctgacactgagacagtccccagcactggagagagaaataatttgaagaatttgaggaagatgatcaaatatgtgaggctccttcagcagccaggcttggaaaggacccctgcttacttgggtacacgggtggtagtagatatcaacaccatttactgaggtaaagaacactgggagactctgaatagataaattagtgaattcagcttctgaatatgtggcttctaaagggaaatattgaagaagaaatcagataaatgcttacaggagatgacatatgcattcaggaggaatatatatgtatagtattatgtgcatataatattgtattaatctctctttcctctatctatctatctatctatttagtgcatgagagagacttgggtgagaatgtaggggagaaaagagatgacaaaccactgaacaaagtccttgagaagtcataaatactcacctagaattgcctaagcccacaaagaatacagtgataagaatacctagtaaaggaaaaaggaaagagaataaaagaaaatgttacagaaacctgggggaaatattttacagaaaaagggagtgaaaagctgtgtcaagtcctgctgggagatcaagtaggatagatcaagaaacatgtctgttagcaacatggagttcttgataactttggcaggagcactttccctggcctaatgggagtagaatcccttttttgaagtagatttagaaagtagctagattgagaggtgagtaaatcaagacaagtgtagtttactcctttttaaaacataagtttgacactgagaagttgagagataaagaaatgtagtaggagggagattcagagcacagtggaacttctggaaaaggaaatatcattctcagaaaaaaaattagaatatttaaactttgagagtgagggcaagaggaggtgaggtttgggaatacgtttcctgagaaggtgacagaattgtatccagagcacaaggaggcacaggtgacagagttggcccttgagagaaatgtttcttccattagagccagagataggaaaagagtaggtgcaaaagtgggaacatttgatgaagtttaaaaaaattaaattgtttgctgtgataatgtctattgtctctgtaaggtaccagacaggggtaggattatgaagtatgagaggcttaaatgtatgaaataagccaacagtgtttgaactagtcagttctggatgtgattattgggtagaaataagaaacagtaaatttcaatgctgaacattgtgacctgtggacatcagtgaccaatagttagggacaatcagagtgcccttttgattcattttctctgccttggctcagcaaccaagatgcaggcattgagaagatgaatagtcagctttgtccacagctgggtcaagttgggctctcaaggtgtgggcagaatacaaattgaagttacttcccattgcttctaaaattactaggaaccaaagtgtatacggtagaataaggaggaataagaacaaatagagaagtcaacaggccatcctaaaaatagcagtggtgattcaagacagaaggatagggtttggggattgaacatgagataaatggcttggagattaaaggatggagcaatttcagctggaaacatggctgatgcttcggaaagcagtggtttgatgggttagaggagacagataacgaggaacaggaagtttggtgttagatagctccactccttcatacgcatgacactggctttagaagtccggaagttttatgaccaatgaattcatcagataaaacagtatattcatcaaaaattcttttaagtacatgatttttctttcagaaatcatctaatccttttgaattatctgtccattcccttgctcctctctattaagagtagtttgagatgcatagagattacacgttttatattcatggtttgtcttctgaatcttttcaaacataagattaatataatcatctctttctatctctggcttttctccagacctcaaaggatttaattcatttaattaatagaatattcagtattcataggaaggctgccttgaagtagaaataaatgatccttcatggacaggttgattatattgaaactatcctcaaatattaagatgtatcaaatatgtcacatatataaaaaaactcatataaaaatatacttggatcaggccagtgaagattaaattttatattctctctataaaatgtataacacgttcttttcttatataaaaattaattatacaagcaatgaataaatatattatcgttataaataaatcagtaaacatatagtatataaaacatgaaatgtcattctttaatgacacactttcagtcccttaaaagtaatagttttgtatttatcctaccagcttttctcccttttaaaaagttatttttattggaaaagacattaagattcattgaagaaatatataacatatagacagttttaaagaagaaaaaatcatctatttatggtaatcaatttgctagaagttatatacacagacgtattctgcttattttcacttactgttcttcataaacatcattgattgctgtgtaatgatattctgtttcatagatttaccaaactttatttcttctagttctgtctctacatgtgtaggtggctccaataacaagtgatgcctcaaagaatatcttacaatctttatatttgtcttcgtttttgaatattactttaggaaatattactttagaaaagaaagttattgttcaaagtatatgaaagttttaaagaatcttgaattaaatcaccaattgtttttctaaaagtttgtttaaacaaatacttaattgtttagggctatttattgatattgcaccacttaactacaatattttcattattcacaattctttttacaaattgtttgctaaaatttgtgttcatttgatgatttgttatgttaaatattctttacttgtttattaactgtaatggacctattgtttggatatatacgaacatttcacccaggttaactatttgtttgttttcctgaagaaaaataatttattatctaacattagccaaaatgatcaatttgtctgattaatctacctcttatggatttttatttatcctactagtcttttctgatagcaaagaacaacaaaccacatatattataaaagtggatgtgtatgcatttttttgtcctttttgtcatttgttttgctttgtttgacttttacatttcaagaatataagaaacagaaagccaaattcctgcacacgaagtgctgcttaaactgtacaaggtactattacatatgttcatcctcccctctccaacctaaaaagaactaagaacgcaggacaaataataatttttaaagtagggggcatctttgacagataagtggtggaacattaaaaataaacttggtcagtctacagttgtatccattctctttagacctgggtcagtccaatttagacaagggtcagtgtcattcaagaattttgctgaggtggcccattcctcattttccttttgcaatcaccttgagtctaagtaaacaaaaactatcaaaccatcctagttgctagcaaaacttagttgctaaaattcctcaagggacacttccaaatctggaattggaggggactttagcctggaaaattagtatgctatcctgtttagaagatacaaattcataggaaaagtattaacttgtttagcagagtgaaggaaatggtaacacacagtgtctgcaaggcggaggttcattagaaacgaaccaatgtcacattttccaataatgtgaatgaggaaagccttatgttaataagataaaatattgttaattttcggaactgtgtggattaaaaaaacctaaaagtttctagagggaataaaaggataataaaacagatcacatatcaagaaatgagaataaaatagtatcacatttccaacagaaaacaaaggcaatgtttttaaatttttgaacaaaagtattaggtataattctacatccagattattaatccaagtgcaggcagaatacagatcttttcagaaatatcaagaacaaatacttctgcctcctttcaacttatttttaggagactgctggtagacgtgcttttgaaaaacaagactgtaacttacaggaagaaatgaaacccaaaatataagaggttccaaccaggggagaagtgatgcaaacttctgagattccagctgttcagctgtcctatgaggctgagtccagattgaagtagggcgacagaggacttcaagaaggatagctccaggaaataaacaacaataacaaaatagagaattatcgattatcagactgtgtgtcagcatctggaagaaactccagttttgcgtatgagatataagtgagtaatacttgatcaaaaaggagagacccaaataaaaatataagaaaaaaatagcttaacaaagttaaaagtgacttttttcccctagaaagtagaattggagtggagaaaatatggaaggaaaaagcttcttttctttgttaaatatgaaatatatgaatactttgataaaatgaaaacataaatagcgatcaaaataaaattgaaagattaaaataaaatggctgggaattgaaacaaggaactagataagaaacacaaaaaaagttgaaaataagttaataaaattaaaaataaattataagaagagaacaaaaaacaacagaacaaagttcacatttgatcattaaaaccaaaacttttttttttaatgtcaataaacgtgggcagggctccacagggatttgcaagacagaaattgcccagctccttttagtatagtcagaaataaggacaattaattggagataaaattattttaaagataacaatgagattccttcatcctttctgtttatccttctacctttacattcaaagccaaatgctatggctttagtttctttgatgcagacatgttaaatgcaatcacttagtcacaactcgatattattgttgtctccagaacttcacagagcatttttctggtaataagtgaagtttatttccaacaagttgtaaaagcatggtgtaagatccttcttgtttttaacttaatgaaaaaaaaatcccatttacattttgcaatgtgggaaaacacatgccacatctctgcaacttgtttgtgagaaatagaaaagcttacacctacattctcttaacacttctctccttatttttggtcattacatttgcagatatgagtcagaagtctatatcatctggagatgaagaaaacatagataattcctgtgtgtgtgtgtgtgtctgtgtttgtgtgtctttccaaatagtgcacaaatgacccaagcaaggggaaaatgccaaaaatcagaaaaataacaaacaaaagtcattaattcatacactattgtgaactgcattttcacactgaaaaaagctaagtaggtaatataaatatgctgcagctgaaaagcatttgacagtctgatatcactttaatcagtgtgtgctcacagtcatttgaattgttcactcataaccaaatgggctattttcatcttcctccagtgtaatacttacagcatcttcttcacaataacttgtaataatactaaagtgaacccctgggactatacatctcacagagttgtagctatatcttgctgttgtctggcctttctgtttcaaatatctcaaaggaataattttcaacatgctagaacctttttcactctagtatctattgtgattgacaacttaatccatgctaattcattgctgacctgcatttttctgactctagcatacctctaaagaataaccatggagaagacagaaatgaaaattagaaactctgacagcagtgttacattcagatcatttgttactatagaattacattccctaaattcatctaacagatctcattgcttttctatatttctttaaaaattattatatataattgatgcataataattatacatatttatggagtacagtgtgatatttcaatacatgtatacaacatgtattgatcagttcaggataattagtattcccattacctcaaacatgtatcattgctttgtgttgcattacctcaaacatgtatcactgctttgtgttgtaaacattcttttttttttttttgagatggtgtctcgccctgtcacccaaggctggagtgcagtgcacgatcttggctcactgcaacctccgccttccaggttcgagcaattctcctgcctcagcctcctgagtagctggcattacagacatgtgccactatgccgggctaatttttatatttttagtagagacgagggttcaccctgttggccaggctggtctcgaactcctgacctcttgatctgcccgcctcagcctcccaaagtgccggtgtataaacattcacaatccacttatctgcctatttggaaatatacaataaattgttattaattgcagtcacccagtagtgctataggacactagaactttttcctcccaactagccgtatctgctatccaacttctggctgtccccatcctccaccccaaacctttcctacctctagtaaccaccagtctacctagtctatgctctacttctatgagatcattttctttttgcttccacatacaactgagaacatgagacatttgtccttctgtgcctggcttattttgctcaatgatgtccttcaggctcatctgtattgctgcaaatgacgggatttttttctttttatggctgaatagtattctattgtgtgtacataccacatgttaatgttgttaaaattacaatgatttttgttatagtgaatcaaataccaaatttatttagaaaaaccactgctggccgggcgcagtggctcatccctgtaatcccagcactttggaaggctaaggcgggcagatcatttgaggtcagaagttcaaaaccagcctggccaacatggtgaaaccctgtacctactaaaaatacaaaaaattagtcaagtgtggtggtggacgcctgttatctcagctactctggaggctgaggcaggagaatcgcttgagcctgggaagcagaggttgcagtgagcagagatcgcgccattgcattccagcctgggtgacagagtgagactccgtctcaaaaaaaaaaaaaaaaaaaaagaaaagaaaagaaaagaaaagaaaagaaaaagaataaaaaaagaaaaaccactgcctctctcccactttcattctgatatgctgttttgaaaacgtatgaaagctcaaatattttatatactccagagatacccatgaatatgtgccccatataaacacatgaacatcattcatattatgtatatctggaagaaaaccgtatagaatgactttgctaaaatatgagactagcacccaagagaaaagatgctctcataatgtataagtggatttgacttcaccacagactgtctctctctctgtgtctctctctgactttctcgctcctccccatttgtgagtttgctttagagaaccttatttgatatttggcatgtaaccttcttaaatattttagtaaatgtttctatatacctgtaaataatatataagaatgtgtatcaggattttaaaatttagctgtacttttccatttctaccttctttctaactttgaacaaaatactttattttagttactatcacagttacctctgggttattaaccaaggttaatgtgaacatttacagttttggtggtggaagtttaaaactgcatttaatattattaaaatatgactggtgcttgtaatggcagcctttggcatgaacgcaaagattgatatgcatcatatttcattctaaatcacaggtaaaatgaaatagctcccttgtgcttgatttgttcctggtgaccatcttgatgattgatgcagataaccacgcgatcagcagcacctgaaataagtattgatcttcatgattgctgaaaggaacagatgagctttcacaagccccttgagagtttggacttaaaaaaaatatctttgacaaatttgaaggctttgatatttttctctggatccactctgcctctaaacattacaaaaggacgattgtctttttccatgttaagtatcctggatttatgacagtctaagatcaatgaagtaaaatagcagaaatcgaaataatattctaatggaagaaatacaaacccctccatgaaatttaaaaacagttgtgagacaaaaagcacttgtttaacgagtcacaatgataccgacaatacagacaaaagacgtttggtgcaaaccctgaattgggaaagaactcgggtggccttatcactgattctattcacttttatactaaattaataataaccctacatcatcgcagagttcttgtaaatcctaataaaaataatatcagagagagaactttctaaatgctaaagttgcattttaatttaaattaaaacagtaattggtaagtacttgcaaaatatgttatctgaacagttcagcaagggatggcaggaatttagctcctccactcctgacctggctactacaaattaatctccattagtctcacatcaattaaaaataaacaatttaaatataaattgtgtacttgctacataattaataaatcagcacaagtcctttaactgacataccactagatctctgtccccaagatcctctcagaatttctggaattgttaatctttgtcacctggttcttttttccttttttgttttctaaagttctggagtaagaatttctgtacatcaaagtttagattttttttgtttgttttttcttttgagacagggtctcactctctcaccagggtggagtgcagtggtgtgatctcgactcactgcaacctccaccccgtccccgggctcaagagacttcagcctccggagtagctgggaccacagacgcacaccaccgtgcctggctattttttgtatttttggcagatacaggatctcgcatgttgctcaggctcgtcttgaactccctgactcaagcagtccgcccacctcagcttcccaaattgttgggattagaggtgtgaacaactacgcctgaccagtttcgatttttaaaatattacattttttcatgtttatatcctcatcatttcatccacaatatttaaaaatggcagcattctaatattgagtcatgttctcagaaaaagaataaaagtttcaaactaggtgtaaaacctagaaaaaaagcccaagttatcactcagaaacctaatcttaaaggtatccacctataaatcctttgctgaataacctaatcttgatctctgttcacagaagcctccattaaccaagcccatagcatcaacagagggagaaatttcaaagggtataaatccaaagtggagtcgtggttgctcttaaaactaatcatacttaattcaaaatttttaatcatttgtcattcttcttttattcagctcctgtcttatttttcaactgacattttggaaatgaaacatccctgtatattcaaaattattttgcagttattgaatttttcagttttgttaaacaataaaaatctatatcttgcaaaactccagctattgcttccatgaaattgatagaaaaacaaagacactgtttttcatgctatttacaaaacttctcatcaaattgtaacatgacaaatatagttctttatcctttaaagaactatatttcatggatatatatagtagttctaactatcattaatgtaataatttattttaaatatgttcaaacatgatgttcaacaaatattagtttcattatataatttcactaaaaagaaaacctaagaaagaaatagttttttaaggtgaatatgccccaaaattgttttctgaaacatcaaagtaataacagaatttccaaaggtggataagtaaatataaggaagtaagcaacaaacatctctaaattttcagtgtaaaatataatgtttatttaaagatatttatgcaagtctgtagtaatttttttcaaacgtgctaagaaaaagtctctttagaataaattagctagaactttctcacactaatataaaactaccagaaaaagaaatagaaaatgaacatgaaaattagcatctatacacttttatatgggagacttcgtaaatggaaatactttgcctctttctctctgtctcctttttcactcataagggtaactccatctacattcttgctaacaaacaggagttgtgaaaagaattagagttggggactttccatcagtataaaaggtctttgctcattaagaatggcaaaaactggccaggtgtggtggctcacgcctgtaatctcagcactttgggagaccaaggcgggcggatcatggcgtcaggagttggagaccagcctgaccagcgtggtgaaaccctgtctctactaaacacacaaaaatcagctgggcgtggtggtgagcacctgtaatcccagatactcaggaggctgaggcggagaattgcttgaacctggtaggcagagtttgcagtgaacggaaatcaagccactgcactccagcctgggcaacagagcaagactccttctcaaaaaaaaaaaaaatgcaaaaactgcttcattaatctggcaacgttattgaatgagatagtcaagacaaattaattgtccacaaacctcagtcttgttttttagcaaccacaactttctcagttttaacttttggtgtggcagtttttatcaatgcagtacatctttcctcctttctcaaacagagaccaatttacataagcaactttcccttgaagactttatcatcattgtgataataattaccatgaatatcataatgagcatctttgtaaatggtattttaatttctgttattaggccatttatacaaaatatcataattaattaatactttttttcatttggttgaatgctaatgaaaatactgataagaaaaggaatataatgttgcttaaatttctttaatgaataaactggctaattcttattaagactacatttagcttgaaattattttaagaataggaaggaaatgacaattctgagaattatttcaacatatgaaatcatatacttttgcagatatgagagacatttatgttgcttttttatatacatacaaatgaaaatgtcttttgaacatttacttgaattttcctatcctacaaataaaacagaggctttcaataggttttatgtagctttgtatgctatacatagttttatgtggctggctacttatttttgcagaaatctttcatctatagaagaattaagagtcatgttttgggaataatctatattttctggtagcactatgtttgactttttaatttttctattaaacaaacaaacaaacaaaatctcattgtgttgcccaggcttgactgcagtggcgtgatcacagctaactgtaaccttgacctcacaggctcaaacaatccccccacctcagccttctgagtagctggggccataggcctgtgctgccacatctggctaatttattttttatgtttgtagaaatgaattctcactgtgttgtccaggcttgtgtcaaactcctggcctcaagccatcctcccaccttggcctcccaaagagccgggattgcagtcatgagccactgcacccagcctactcttttcttacgatgccaaaacatttgcattggtcgatgcagtttttcctttaattccgcttttcaccaaactaatatgaggcagccaatgaaagttagaaatacatagtattttctgaccagaagaaataataaatgttgaaataaaagattcaatcaagatttttggttgctaattttctaaagtgtttcttcaccatctaggtatttttccaactatggactctgaaatctatgggagaaagtaagttataataaaaatatgggaaagagtagactttattgtgctctactgttatagaagtatttttaggtggattgtgtttttatttctatttttaaaatttgctccaaatgtaaataatgtgagacttggctttgtaattattttttaatcccagtaggtacatgaaaacatgtacaattggtcctcagtatccatggcatctgcatccatggattcaaccagccaaacattgaaaatattagaaatttgggcatctgtggattttgatatgtatgggggaacctaaaaacaatcccccataagtgccaagggagggctgtgtgtcgtttacacatgtaatatattttattgataattcatgtctataactttgttataaaaagagtccgaatattatctgatgaaaaaaatgggtatgggaagatagaaggaaataaagacagaatgtgcatgtgtgtctgtgtgtgagtgtgcatgtaaggtgtgtctgtgtatctatatgtttgtgtgtaaaaagaaaaagagaaagatagaggcagatgagaaaatgagaatgttagagagtcagacaggtggagaatgctgttttccaacatgtcaaaagtggttttctctatatttgggcagggtgcttgtttttaacaaattattattattgttatttataatctccaggtcttttctactaaataaaaattatttttaaaaagtcagcttcaaaagttaaaaagcgcatcatcccatttaactcagaggctaagcgctttcagcagcacataataaaaccttctttaatgcatgtattatcccaaagtcaaatgatcataacaacaaatatgatgggctgtggcggctcatgcctgtaatcctagaaccttggtaggcccaggcaggagaatcacctgaggccaggagttcaagacccaacctgggcgacaaagagaggctctgtcactacaaaaattaaaataaaaataacctgggcatgttaacacatacctgtggtcccagctactcaggggctgaggtgggaggactgccggatctcaaaagtgtatatttggctcatgcccttactttattcacctctctgtttaaatgccacttccgaagaaaatacttctgaatcatccttatgcatctctgtcatgatacctgctttatggttgtcagagcacttaattccaccaaagattatacatttcatgatgtcttcctaccttctccactagtataaaatcttcacgactatagaggcagtgttgcttttgttcattgctttacccccagcaccaagaacagcgtgtggcacaaaagagattctcaataacatttcttgaatgctattaaagtgaatttgcatagaaatatttaattgcaattattatttgtattgaatacctggtgctatgagatttaattggtggtcttaagtcaacctgagtgtcagagtagccctccttgcaaagtgacaagtgataagagaattaagatttgaggttaatgaaaagagagtctatggggcaagaagatggagccaagcacctatagctgggagaaatgaaaagagaagacactctagaaaagggaattttgacaaggctggatcaggggggtgctggtaaaatttcataactgactctcagggggaaaagacgtgatccatagtattttctaattgctgaggcataaatgcttccaccatgatttcaagttaccagcgtgacatcactgaatgcaaagctgagtaaatatgcacagaggcacatcattatataatatttccagcaaacagttacagtagaaaaggaattcagtcgtttatttgttaattattctgtgactcaaatggcatgaggtacctaaaatatctgtaatcactttctttgtcacatatgtgagatctccatgacataattaagacctacaactactaaacagtgttagcaatattattcctcaatggggaaggggtgatttaaattatttaggtgcatttaaaagttcatttgtcatcttctctgtatacaattccatgaaaaacactgtttaagagaaaaatacttttaagaaatcagagaatctatgtatatagctagaaactgtccaatttgaatagaaaagtcaagtaaaataatgaaaatgcaatacatggtatgtacatacagtattactaagcctttttaaggaaggaaattctgccatatgcaacaatattaatgaacctagaggacattatactaagtgaactaggccagtcataggaaatattgtataatcccacctatataagctatctaaaatagtcaaaatcatcgaagcagggaacagaatggtggttgtgaggggatgagaggaggaggaagtgagttgttcaactagtataaagtatcagttatgtaagatcactaaattatagagattttctgtagagcatcatgcctatagttaacaatattgctttatacacttaaaaatttgttagggtagatctccagctaagtgttcttaccagacaaacaaacaacaaaataaacaggatgaagagggaggaattttggaaatgactgatatgttttgatttttttttaccttgattgtaatgatgatttatagttgtatatgtatgttcaaacccatcaaattgcatagatgtctgtagtgttttgtataacaaacatctataaagatgtttataaaaaaattttaaaaagcaagtaaaaaaatcaaaagaccctacagaatgcactgtaacaagtaataattaacacctactttctagaaaaacctctagatgagatactatattgattttttaattattaaaacattttttattttttaaaaggtgaggtttttattatgccaaaaaagatgaacccattcacattttaaaatatcaaacagtacaaaatatgttatgtaaatctaacatctcatgtcacatctgaatggcttcattttccactttccctcaagattaacaactgctatcattttttcttagcctccttcctgacctgatccaatgtatttttatgtcttcatatgcctgtgtaaacaaaactatgtaaaacacttttctactttatgtacatcttctagaattaaccgtttctatctaattgttccattgcgtcctgtaaatatggttccccaaacaatgtccagatggttgtcattagagcagcctactgtttttttgttgttgttaatctgttatctcagatttggcattccctagaaatcatccacttttttaaacagtctcatctaaatatgctttggtttcctctgtcaatctgaaccaatctgttttttatcttctgtttttcaagatttcttttcatttcaaaatatttggtctcctaatgaccttgcattcattagggttctttgattaccagcaacagaagctgaatccaattaagaaaaataaatatattgagagacaatgagtcttcacagactagtcatgaaactgagaaaagaggctctggcaaggataaagtgcaaaaatatattaatgcaaacaatatgaccactgtttttggaatgaatagacctgaagcactttactgtcctcaagatgccgcttcagagggaattgtataggaaaaaatattggcaaatacatactttaaaaagtaatcataaaaattgatcaaaataatttacactcaaagcaataaaagattgtgttgatgaaaatgaagttcacaggtctgaaagtcacacttttgttaaatttaagcctagagtccagatctctgtgtgatgtttcttgttaacaagaagtattaatagcatcttaaaatgcaaggtattattacataactgcatgaattgcatttcttttcgaattttgattaactaacacagaaattattttctggagaatgattccagatgataaaaagtcaaaatgaagcctatattctttttctttgttgttttcttttagatcattttaatagactacatatgtactgaactgtgcattccttgtggcaaaagaaaatatttaattcttcttcaaacagcaaacgtttttaagagtgctctcacatcaaaagagcccaatttaagtttgttaaataaagctttaatatagagagaagctttaagttttcatttcaaaataattcttaggcatcagcacaacaggacagacaggcacttactttctttctgtttaaacgtgagtcatgttagtttatttattatgtgaatttttctagtggcttcgagttttgaattgaagtgaaacttcacatcacaatgatgaatggagctctgctacattttagctatcgaaaatatttcaaaaataagaactcaagaccaagtcttacttggagagagccataaacatattcatgttggctgaaagcagataatattattaactgagtactcataattaaaatatgaaaaatgtattatcatcacagaaaagtgatcataaaaccatagaaaaatcatagattgtattggcatttattttcagcagcttgatgtgtagtttctgctattcaatttcctacatcataagagtaataataaatgagtgtttctagcttcctttcccacactccactagctaaagatgattctggtttgttctttttttctctcccccatttttctgtggagactgaacaatgtcagtcaacctctgaacataacagaaggatggcgattatgagaaagtgctagagaggagagagggttggaaggatctagcaaagactgaagaaatgcaaacaaaataaatgtttatatgaacacttttatttgctccaaaacaaagttaaaattttagccgggcctggtggctcacgcctgtaatcccagtactttgggaggctgaggcaggcagatcacctgaggtggggagtttgagaccagcctgactaacatgtgaaaccccgtctctactaaaaatacaaaaattagctgggggcagtggcaggggcctgtaatctcagctgcttgggaggctgaggcaggagaattgcttgagcccagaaggcagaagttgcagtgagctgagattgtgccgttgcactccagcctgggcgacagagtgagactccgtctcaaaaaaaattttaagttaatttcaggtatttttttagtatctatatttctttacagcctttttggagctatttcaggctctgaagcaacccaaaggattttgaatataaatgtagaacaaagcaacactttgaatcgctatcatatcctttaattcggtgaaaagctgtgttatctgtgaaacgtggacaagcgatgtatattgaactccaaatatagcatcttaaacagttctggcaggatgactgattcacacaagatataaaagcttcagtagttaagaaaaataatttgggggtaggtgttcattgtatcatgttgtagatttgttttggcaaaagcaaatgaatttcatcaaatctgttatgccatatctttgtacttttccccaggaatatgtataccctgcaaacaaaaacgatgttcttacttttgttgacagattctaataaccaatatccatctgaaatatctatcaggcctcagacaatattttgagagttttttagtaatgatttgcaggacattctgaagatcacatcctcccttttcaaatatataatttcactgattaacgatgcaaacatcacattttagatcttaaatgacattggtatccagtaacttttgaacaactgactttgtgcaatcatatccattagcttgtccaaacaatacaaaaatctaatttatcagtttaaaataaatgttgagtgataagtagatttttaaacataacgaaaattaaaatttaattccttaaaaagtttatgtgtggtggatgcaagatgactgaataggaacagcattggtctgcagctcccagcaagactgacacaaaagatgggtgatttctttatttccaaccgaggtacctgtttcatctcattgggactggttggagagtgagtgcagcccacggagggtgagttgaagcagggtggggtgtcgcctcacctgggaagcgcaaggggtcggggaattttccccctacccaagggaagccgtcaaggtctgagcctgaggaattcccgcacagataaagcgcttgtccctcggtcttcgcaacccacaaaccaggagatcccctcttgtgcctaccccaccagggcccagggtttcaagtacaaaactgggtggcaaattgggcagacactgaactagctgcaggagctcttttttttccataccccagtggtgcctggaatgccagtgagacagaactgttcactcccctggaaaggggtgctgaagcaagggagcgaagtggtctggcttggtgggtcccacccccatggagcccaggaaactaggagccactggcttgaaattctcactgccaacacagcagcaatctgagatccacttgggacagtccagcttggtacggggaggggcgtccgccactgctgaggctcaagtagggcggtttgaggtcacagtgtaaacaagggtgctgggaacttctaactgggcagagatcacagcagctcagcaaggcagctgtggccagattgccagatttctcctctctggaaagggtacctctttaaaaatgcagcagtcccagtcagggccttatagcagacttaaaagtccctgcctggaagctctgaagagagcagcagacctcccagcacagtgttcgagctctgctaagggtcagactgcctcctctagtgggtccctgacccctgtgtatgctgacttggagacacctcccagtaggggccgacagacacctcatacaggagagctctgactggcatctggcaggtgcccttctgggttgaagcttccaaaggaaagaacaggaagcaatctttgctgctctgcagcctctgctggtgatacccaggcaaacagcgtcgggagtggacctccagcaaactccagcagactagcagcagaggggcctgactattagaaggaaaagaaatagacagaaaggattagcacatccactcaaagatcccatccgtaggtcaccaacatcaaagaccaaaggtagagaaatccacaaaaattagaaaataacagtgcaaaaaggctgaaaattctaaaaccagaacacctctcctcctccaaaggatcacaactcctcaccagcacaggaacaaaactgaatggagaatgagtttgatgaactggcaaaagtaggcttcagaaagtgggtaataacaaactcctctgagctaaaggagcacgttctaacccaatgcaaggaggtaagaaccttggaaaaaggatagccgaattgctaaccagaataaccaatgtagagaagaacataaacgacctgatggagctgaaaaaacacagcacaacaacttcgtgaagtattcgcaagtatcaatagccaaatcgattaagcagaagaaaggatatcagtgactgaagatcaacttaatgaaataaagagagaagacaagattagagaaaaaagaataaaaaggaatgaacaaagcctccaagaaatatgggactatgtgaaaactcattctacgtttgactggtgtacctgaaagtgacagggagaatggaaccaagttgtaagtcacgcttcaggatattatccaggagaacttcctcaacctagcaagagaggccaacattcaaatttaggaaatacgagaacaccacaaagatactcctcaagaagagcaacccgaagacatataatcgtcagattcaccgaggttgaaatgaaggaaaaaagttagaccagagagaaaggtcagattacccacaaagggaagcccatcagactgacagcggatctatctgcagaaaccctacaagccagaagagagtgggggccaatattctatgttctcaaagaaaagaattttcaacctagaatttcatatccagccaaataaagcttcataaggaaggagaaataaaatcctttacagacaagtaaatgctgagggatttgtcaccaccagccataccttacaacagctcctgaaggaatcactaaacatgtaccagccactgcaaaaacataccaaattgtaaagaacattgacactatgaaaaaactgcattaactaatgggcaaaacaaccagctagcaccataatgacaagatcaaattcacacataacaatattaacctcaaatgtaaatgggctaaatgccacaattaaaagacacagactggcaaattggataaagagtcaagacccatcagtgtgctgtattcaggagacccatctcacgtacaaagaggcacataggctcaaaataaaggaatggaggagcaaatggaaagcaaaaaaaaaaaaaaaaaaagcaggagttgcaatcctaatctctgataaaacagactttaaaccaacatagatcaaaagacacaaataagggcattacataatgataggtcttagagacctacaaatagacttagatgcccacacaataatagcgggagactttaacaccccactgtcaatactggacagatcaatgagacagaaaattaacaaggatattcaggacgaactcagctctggatgaagtggacctaatagacatctacagaactctccaccccaaatcaacagaatatacattcttctcaccacctcatcgcacttattctaaaattgaccacataattggaagtaaaacactcctcagcaaaggcaaaagaatggaaatcataacaaacagtctctcagaccacagtgcaatcaaattagcacgcagaattaagaaactcactaaagaccacacaactacatggaaactgaacaacaggcccctgaatgattactgggtaaataacaaaataaaggcagaaataaagatgttctttgaaaccaatgagaatgaaggcacaatgtaccagaatctctcggacacatttaaaactgtgtagagggaaatttatagcactaaatgcctacaagagaaagcaggaaagacctaaaattgacaccctaacatcacaattaaaagaactagagaagcaagaggaaacaaattcaaaagctagcagaacacatgaaataactaagatcagagcagaactgaaggagatagacgaaaaacccttcaaaaaaatcgatgaatccaggagctgttttttttttttgaaaaaatccacaaaatagactgctagccagactaataaagaaaaaaagaacaaacgcaataaaaagttatataggggatatcatcactgatcccacagaaatacaaactaccatcagagaatgctataaacacctctatgcaaataaactagaaaatctagaagaaatggataaattcctggatgcatacaccctcccaagtctaagccaggaagaagttgaatccctgaataagccaatatcaggttctgaaattgaggcagtaattaatagcctaccaaccaaaaaatgtccaggaccagacagattcatagcagaattctaccggaggtacaaagaggggctgataccatgccttctgaaactattccaaacaatagaaaaagagggaatcctccctaactcagtttatgaggccagcatcatcctgataccaatacctggcagagacacaacaaaaaaaaagaaaatttcaggccaatattcctgatgaacatcgatgtgaaaatcctcaataaaatactggcaaaccaaatccaccagcacatcaaaaagcttatccaccatgatcaagttggcttcatatctgggatgcaaggtggttcaaaatacacaaatcaataaacgtaattcatcatataaagagaaccaatgacaaaaaccatatgattatctcaatagatgcagaaaaggcctttgataaaattcaacacctctccatgctaaaaactctcaataaattagatattgatgaaatgtatctcaaaatagtaagtgctatttatgacaaacccatagccaatatcatactgaatgggcaaaaactggaagcattccctttgaaaactggcacaagacaaggatgcccaatcttaccactcctattcaacagagtattggaagttctggccagggcggtcaggcaagagaaagaaataaagggtattcgaataagaagagaggaagtcaaattgtctctctttgtagatgacatgattgtttagaaaaccccatcatctcagcccaaaatctccttaagctgataagcaaatttagcaaagtctcaggatacaaaatcaatgtgcaaaaatcacaagcattgctatacagcaataacagacaaacagagagccaaatcgtgagtgaactcccattcacaattgctacaaagagagtaaaatatctaggaatcccacttacaagggatgtgaaggacctcttcaaggacaaatacaaaccactgctcaagggaataaaaaaggacacaaacaaatggaaaaacattccatgctcatggataggaagaatcaacatcgtgaaaatggccatactgcccaaagtaatttacagattcaatgctatctccatcaagctaccactgactttcttcacagagttggaaaaaactactttaaacttcatatggaaccaaaaaacagcccacatagccaagataatcctgggcaagaagaacaaagttggaggcatcacactacctgactttaaactacactacaaggctacagtaaacaaaacagcatggtactggtatcaaaacagatatatagaccaatggaacagaacagaggcctcagaaataacaccacacatctacaaccatctgacctttgacaaacctggcacacacaagcaatggggaaaagattccctacttaataaatggtgttgggaaaactggctagccatatgcagaaaactgaaactggacaccttccttacaccttatacaaaaatcaactcaagatgaatcaaagacttaaatggaagacctaggaacataaaaatcctagaagaaaacctgggcaataccattcaggacataggcatgggcaaagacttcatgcctaaaacactaaaagcaatggcaacaaaagccaaaatagacaaatgggatctaattaaactaaagagcttctgcacagcaaaggatactatcagcagagtgaacaggcaacctacagaatgggagaaaatttttgcaatatatccctctgacaaagggctaatatccagaatctacaaagaacttaaacaaatttacaagaaaaaaacaaccccatcagtaaatgggcaaaggatatgaacaagcacttctcaaaataagacatttattcagcaaacagaaatatgaaaaaatgttcatcttcactggtcattagagaaatgcaaattaaaaccacaatgagataccatctcacgccagttagaatggtgatcattaaaacgtctggaaacaacagatgctggagaggttgtgaaaaaagaagaatgcttttacactgttggtgggagtgtaaattagttcaaccattgtggaagacaatatgatgattcttcaagcatcaagaactagaaataccatttgacccagccttcccattactgcgcatatacccaaagcactacaaatctttgtatgataaagacacatatttagagactctcattcccattggaagtcaaagtgtttgtccttccttctttgtaaacaacaataccctgaggtgtattctgaaaacaacgttcacagctgaaaaagcaaaattctggttttcaacgttaaatgtgttacctctttgtaaaataagatactattttctctgtttttttaaaactcaggaaaaattatcatccaaagttagtaggtaatcagttcccagatttctcaaaatagtctagaaatccaagtttcatttttctagacacatttgaacttatgctattatgtgtcctgattttgccttcgataaaatatatgtaatggaaactagccatgttaagtgtttattctgtgccagcatagtaagacaaaggctttcttttcaaccaaactctagtcaggctccatcttcttgattaggccccaaatttggcctgcaaaacttgcagactttcagcacaaatgattttgtctacctttaatgctaagggacttgaacaaacattaataaaattttcaccagctcaatgctgtatccctaagataattactccatcccccttaagttcctgcttgggaaatgaagctcaaagttgccaaaatactccagccaatacctgaacatcagacccgtctcccagtctctttgggcagatagaagcctgacttctataacatccagttggcaaatccagagggcctcattgttttaactaacctccacttccacttattgtaaatttctactactgcgtctgatcaagtcctccctcatggctcctccctattttctcattctcctttaaaatgcccagtcatctctgctcaaattaaagttgagttccatttacactgggctttcttctctatcgcaatagttattgctgaataaaacctgttgtttccactttagtgcctggatttgtttatttttgacaacaactactacatgtattaacttatttatttattgcctcacttttatgaagtggagaatattatccacatagatgagtaaataaaaacaagagaaagtcatgtaactttttcaagaccaaatagttgctcagtggtgaagtggtgagttgacatccagaattctggcttgagaatgtttgctcatatacttgtagctttggcctacacttaaaaagccagggactacatttctattactgtcctcaaccttagggtaaacacaaatctttttatttattctatataataaggatgaaatttaatcctagcagagttcaatctatggatcacagatactgtacctatttcttattcataaacctgacttaatcccatttcacaatgtatttctaattataatgacatccactttgatcttttatagccatgctatttagaagacattggtgttttttatgttcttttttcaaaatagtactttgactctcatgttatatctataaataaatcaaatatgttattgcaatatcaaatgaatacacacacacatatatataatgtacatatgctctacatgtatggcattagaaaagaatgaatatatctttagaaaaaatggcagatatttggtactagacacaatagcatttgaagcataaattgattattacccattaaatagaaaatgtcagtactattcttctttattaagccattggtgaaaaaaatgcctacatgatccacaaatatactcattcattataagcaggcatctctattagctttaggcactacattattaaaattataacttcactaagcagtcaactaacttttaatctctgtttttatgtggtggtaaaattctactgcctgaaaataacaatgttataaagaacttttctataaatttacaaactgggagaaaatctaaataactttctgaaataatcagatttcatttgagcctaaagtgaattgaaatagtaatggaaatgagctataattttcttcgtatagtatgttattcctctagtgagaactgattaaaaatatgccagtgttcaggcacattttattattcaccatattgatgaattcaggttatcccaatgtgagctgaaataatatattctaagaggacatattatccttcacggaaatatgcataataaagagaaatttaggaatctatggcttatggtgtgttgattgatctctagaggaagctccactttgttttgtgccctggagattttcatactcgggaggtgcatcgcaggaacacatggaatctgtaaagggtgtggctttcttttgtaaactacaaagtcaattatgtgcaaattttaaaaagtctatttaagaatatagtacagatagaaggtgagaaactacaagctgattttcttaaaatgatttgcatccttctcctgaacatcgttctgtgctaacatggaaatcagtatcctattttgaggcactgttacatatattttggagatgctttatgttaactaactcactctttattagtaaatattgatgtaacaagggagcaaaaatgttgagatatgcacaatccttacttacttgatttttttcattctaatagcacataaatatttttatttgtattttactctgtatctacatatttgcttttttgtgttttatttgtttattcctatttttatgacttattttcctgaaaaacttgccatttgccatatgttctaatactactcatatgaatatctaggtgcttaattttaagaatgaattaataaattaattgttacctaggtaaaattttagtaaatacgattaatgtaattagagattaattttatgttaccatgaagcatactagtactaagaatcagatcccacaggaagtggatatcaggtccagaactgagaagagaatagacaatattcatatagaagaagagcgagatgatcagaaaatgacacaggaaccagcagagcgaagagcaacctaaatcattagttgagaaatgttttgagcaggtataatagcacattgctgcaattgtctgagcattttaacaaatgtttgctaggtacttttcaaacgctaattaattacaatcctcagtatctctgcaggaaacaaaagattgatatgtacccttagaactgtcaaccatactgtcaaatatccactacttgccgtgctcatcaccacagtctccttttttctactctgctcactattacactaacaatgggcaattattgaaacaaaatatttgggtatttttaatgtcattattaataaatccaaaaatatttagaatgaccatttgtacctctttgtatttgtgtcagtttttgtaattttgctgattttttgtttgctttgctttcaagaggattttaatgatacaggtttaatatacttttatgaaaaaatatggcacaagcactgtttgaaaagtgataaaaattattggatggcctgttgtctagtaatgctcatttttttcttcacttattatctctaatgatcactctctatgtgtatttaacacctgttcatttgtcctttcactcatctcacccttaatattcatgtatctggtgatcactgaagatcactaatagattcccctcctatcccaaacattaatattgtacaatatccttcctcaggccaatgtgtaatctgggtcctacacaagtagtggaactttggtcatcttagagagagcagccagaagcagaataggatgggagctgagacagagggaccaagatcagttaacaagccaaagggggtagctaaaaatttagaagtaaatgagggtggaattagaatgtagaaagaatgattttggcaacttctataaagagattatggagtccgacttgcctttcttggccagcaaatgtgctctgaattaagttggggcaccttaaaattactttatatgaccaagaccaataaactttgtatttaccacgtatttaatcaagtacatacaaaattaaataaatcattactttacatttaacccaaaatattgtgcatgtattctttactgtctatacccaactttttctatttagatatttggatgctaattgaacaaaataatcagaattgagctattactgatatctaaaccacttttgtatcatcagccggtattgcaaaataaataaataaataaataaaatataacaagtagtcaaagcagtaacatcaataagtacataagcaaaaagccaattcatacatcctcctgttttctgtacacatgttaaacatatggttattatctatgcaatatgccaactaagtttaccccagttgataatggctgcttagtagatactttatatctactaataatataaagttaatttcctaaaattgtacttcattaaacaaaataatacacttatttctatataatcttcacatgcttaggcattagaaaatggctttgttaaattacaaaggtaggtaaatagtttattactcatctttattagagcaaatacttgtgttgttgttttccttcctatataagcacagaattataactattaattgtttaaatgtatttggagtttcttcccaaatctgacaatgagtcactataaatgagctatgtcttcatcagtttggactgctataacaaagtaccaaagactgggtggcttgaaacaatagaaatgttttccttacaattctggaggctggacgactgagatcagtgtgccagcatggttaggttctggagtgttctcttctggcttacagattactaactacatggcggaaagagcagagaaagttctctgaggcttcttttataagggcccagatcaattcatgagcgttccatcctcatgaacacatcatttccaaaattcctcacctcctgataccattacattgggaattatgatttcaacatttgaattttgaggggaaacaaacatttagttcctaacatgctattaatgactacatagcatttctgttttattttaaaatgaaactaggtttcatttatactgacgctcctaaaaagactggtgtatttcataaagccaaaattcttggatgtattgacttggaatcattcaccattcattccatgacaggctggatacctaaagttttggattactgtttttgggtttggagggttttgtttgtgtttgtgtttgctaagcacataatttaaacagataatgatattgtaaaatgtttcatttgttgactttggattcattaaatgatactgtgtcttcagagaataaatcttaaaattactttgggagtatccacttactattaagtaccatactttcaaaacaaaaaaacaaacaaaaaaacaaagaccggatttatttagactggatttattttttaaatgacaatattcttacttgttcaggaaagcaggaagcccagtagatactgaccaagtatatttactacaaagcaatgaattaatatttcttcttaggaactcagactttttgatcatccaaacatagctctttctttatccactagaaatcaaaggtatagcatttttagtaagctgaaaaataattattataaaactgtggtctttgtgaaaaagagtaaaaacatagatatccaaggctacatcttccattttaaaaactctgtttctccagagcactatatttgaagtgcacttaggtctcattttacaagagagcagaaatgtgcatgttggacaatggtacagagaggacgtggttcccctatgcaggagctccagttaatacaacacagtgcagagcaatggatgcctgtacctttaactcagttaaggaagaatttattttaacttattatgattatcctctagcccaaaatttgtagaatatttgtttattgtctaaacagaatagatttttgggagccttcggtcttgaaatattctttcattacttgcaaattgcaacgtcacctcacagaatttccttcacagaaatgcttagaataactaaatctttcggtaatctcataattattgcacggtttatgaaacttttgaaacgtattgttgacagtgtttcataggttaaaagtattcttcagaagacaatatttttactgtcataatttgttactacctgagattgtctttcttgaggaaggtatttcagaaaatttcctgaaagcttttagaccttagcacacatttattttttaaatctaattttagttattttcactagccgtaatatttgttttaaaaaatttgctctcttggataaaatttatgttttccttttttatttctcagacatataacttgttcatttcttacttttcaagaagaaataggtgtatagagatacgcattttgcctctgcttttctatatggggcagtaaaaatatagcaaatatgtatatgttagctattaataaaattgggacaaaatagtagaaaaagatgagtaactgagaaggagaatggaataaaaattaagggagagcgagaaacacaggcagaggaaaaggagggagaacacatggaacaacagtgatgaatgggtggtgactagaagagttataatgttgatagaagataaaaacataggggacaagtcagagcagataaagggagtgaggaataattgaaagtcaataaaagaagagagaaagaagaaaggacagtgtggtgaacaatgaaaatactggatataaagagaaattctggacagtgaaggaatttggtggggctggagcatcagagcttattttcactgatagttcgtctcaaaacctagagaaataaagtggacccactccactcagaaaaggctttcctcccaacttgacctcttggagtcatgaggaccagacccactggtttgccagctagttactggccaattcatgttccagattgcagatgcattaggattcctgtcttcgtttggtggagtcggtcattgcttactatcctagataatttagaaagtctgaatttatattctgggtaccaagatactttctaagtaatcagggtcccagtgccatgacaagccatattcgtggcagaaataaaagaaaaaaatcagtaatgctgatacagtctctattttttaattttgatattttgttcaccatagatatctttgtgtcaattttgactttaacatataacatgagatgtgttgtgtcctgatttactgtttttttggcatcctctaaaacttcgcaactaaagctagtttatcattcacctctctcctttcccagccctagagttttccctaatcattcagtataagtaaattattacaacggattcctatccttattactgtctgagcacacctgtttgccagcagaactggagccttgcttcaaaaagcaatagaaagaaagctaaaaatctgtcttcaactgaattgtgaagcctgaactagtttaaaaaaaaactagtagaaaggaaacagaggaaaagaacgaagagtgagtgtgtaagaaaaaaatttggctggtttcttttgccagtttctgggaggtggtctccaaatccttggaatttcctgagtgataggagtgtctttgttattcatggtgtcccctcttcattaccctacttgatagcttgtgctaaggagatgactcgggatgagggctggtcaaaccagaaagactatatattagagttagggatttgggccagctgatagtagcctgaactccagggatgagaaaaagactggagagtgggttacataacaggtcagtcaaacaatcaagcctatgtaatgatgtctcaataaaaactatgaacaccaaagctcaggtgagcatccctggttggcaataatttgtttgtagtcacccatcaatgtggtgcatcctcgccacagggagaggacattcaaagcttcccctttgggaccctcccagaccatgccatgtgtgtttccacctttggcaagtactgatttgtatctttttgctgtagcagaattgtcattgtaagttagggctttcctgagttctgtgagttgttctagcaaattatcaaacaaggagtagtgggaactcctgaatttgtagccagctggtcagaagtgagaacgacctgaggaccactgaccttgtggctggtgttaaaggcgagggcagtctcgtggggttgggggggttggcctaactctgggttagttgttatcaaaagtcactgcagtgataaattaatgctttgtttctgatggactttaagtcagtggcccccaaaccacttgtgtaaattttgacctaccttcaaagcttgactcacgttcaatcatctttatgaaacatccgaaatattccagctctcatcaattagtttctcctttgagcacccaaaatacttgtcaatatatgttatttagcaccttgcttcaattaaattgcaacattaagtgaggctagtgacttttactacagtgcttgggcaatgtattaatttcataagttattccaagaatctgcaaccaacatgtttggaaatttttgatgtttatagcaataagcttctgtgtaagagtggctgcttcccatgatttttctgtttttgttcaccatttattggtataccaaaatctcaaatttcaacatatgttgaataatgtgtgtatatgattttatatatagtatgtagtagtgtacccactaaattataagttattgaggttcttgattctgccgaatacttcagtgtctcccaaaacaataataaagttgcaatcatgtttcagtgaattaataaaatttgcaaaacaaaatgtagagaacaaaccaaatctgccaaatctaaaaagttagctttaatttctaagtttgactacataacattggaattgggttgattcttctaatgctgctcagataagaacgatatacatgacatacttgatatgtttccattaagtgttcctttaggaatgctttataatccccaaatttgatcaaactgtctctcaatcatagccaatttagaaactctgtgtgtgtgtgtgtgtgtgtgtgtgtgtgtgtgtgtgtgtatcatactcatatatgactggaagccaagctggttgattttgggagtagattagaaaatgaagtacattaataaagaatggttatagtgcttttgtatgtttgttttgtttttgttttgagtgtttttatacgtatctttgttttagtatataggcacactaaatattatgtgcctatgtactaatgtgcctaggcacattaaatattatctgagcttaaaccattgttacagacattatctcacatttcatttatttattaggtttaacatgattttcctgtattgtatttgaatattattaagttcatcactggaacacaacggataccttattgatgttcatggtgagtactgaaattgaaagcaatcaaattaatgaagattttgtgtagattatccaagagatttacagcaagtagcatgatgattaagagatttcttaaatgaaatcctcttgcaattttttctgtttctacatacagaaacaactttacaactttctgtatcttacacttaattagttagcaatgattgcatacataagagaatagaaaaatatagaaaaagaataatgaatttctctatgcagtttgcacggcttagttggcttctgctgacctaaatgaagtctaaatggaagaagcttatatgttccaaactctgacgtaaattcaaattcagaaaatgtaataaggactataaatccctttattcgtcattgtgagtcactaaatatgaactttatttatagctgtgtataattatatagtctttggcttgccataagcaattttgacaggagtaaatatcattagagtagaaaatctttcacctacacagatctatgcttcccagttaatattcgtgactaatatattgtgtagcactatggatgttaggaagcttttctccacgtacacagcaatggttcttgtattatagatattttattggctgataaagtatttttactggtatttatgtagtcttatttcccacatcacaacttccgacttaaatgagtgaagacagtttatttttttcttcagaactaattgaatgaattctgaagacttgctgtttaaattatgcaaacataatattttctcacatttatggctgtcgtaatgtttctgttgctgcctcaggaactgcattgtacttaatgtagttacagataatacaactgtcataactgtcataaagaccacgtgacaagccaggcattcccacagtcacacacctcaagcacatgtagccctataattaaagttggagctctgccgctcacaattgcagttttgcataaattatgaatactgtcagaagtggcatttttaatgaggataaagttgagagaagaatgaaagcggtacaaggagtcatctctggttagggaggacctcatggaaataaaacctagcagatgtacaagagtcaaaacaaagaagatcctgacatcattatgcatggcttatgtgaaattctcttaagtatctatttttgagtcacatgtgaagtgtgtgagctcctccgctcacagaagcttcagctatcatgggatggatttagacttttggagattaagcaatcctattgtctaactcaatggactagaaattcttagagatttgatcagtctaagtccagttgctttcttcaagaattgactgaatctttccatcaaagacaagattttataactcaacttctctcctgcatagctaggctaaaattcttttaggtcaggcttctgacaatacttgaattttctgtttgtctggacaacaaaatgcatttatggcaaatgtccatgcaaaacccccacacagctagttatagcatacaccatgccattgtactttcaaagccagctcttcagatcatctagcctctccttatggttctgtcagaggaatctagtatttccatgataaaccaaaatgtggttatctatgactaataatggataatagtgatggagaagctctacttgtaaaggagaggctggccagggacagtggctcaacacctgcaaacccagtattttgggaggttaaggtgatacaatcacttgagcccaggagtttgataccagcctgggcaacatagtgagaccttgcctctctctgaaaaaaaaaaaagaaaaaaaaattagctgcgtagactctttggtttgccataatggcacacgcctgcagtcccacctactctggaggctgagatggaaagattacttgagctaggtagatccaggcagccatgagctaatatgtgtcactgcacatcagcctgggcgacagagcatgaccctgtctccaaaaaaaaaaaaaaaaaaaaaagagtggctggagctcctggagccacacagatttctgttgtagctaccgtggccaagatgagggatgctcttcttttaatgcccaaaggtgaaaatattattcaatcctaaattctccatggtacagataaatagtcctggttcctttaaataataactagaggaaagacaaacgatagatggatgggaatacagagagtcatgtaaaattatataatctgattcacataattaattttgctcttctctgtggacctcagggcattactactactgaagcccacacttggtcagctatcatctctggcgtctatattttacaattcagtgtgcagagagaaaaaaaaatatgtcctttccaaactctaaatttctttctgaatatttaccttcccttgagaagattgatgctcagtataatatattcccaaacactgcctcctgtgggaaagaactcacatcctacttacaaaggtctggccctactacatggctggccaagagaccagttatattaggatactacaaaatgcacatgactgtgcttttcctcttctgcaaattttcttctattgtgtcaacagcaagttttcttttagttttgtgaaacattgtgtatttgataataaagttttaatttcttgtgtactatctcatgaatattttgtgcagaatattgtcttgtaaatttttagttgcatcagttctcattcttagaactcagttacaaattcataggttaacctttggaaaaatcatggtgacaagtttgcaatgcattcagaatcatgcttcctaactggtttatatggggaatagttattaagataaaatattaatggaaatgacctcaatcaataagatgttatgaattttttcagaaacccaacttgcctttatcagcttcacattatagatgctcaaaggaacacattggtggttgatagtttaaaatgagggaaaaaagaattgacgaagcagaactgttaacttgaatgttcaagatacttattgaagactttaccaacaaatgtaatcatagaaattttttaacatattttcatttttaaacagaactacataaattttagaatacttatgtgtatttttaattgttttatttactagcctttcctttaggacatagcagcagatataataatagctattgaaattgatcagagtctattcaattatatcatctggcctgtaaccacaaataatgtagtcactaaatgattgcaacgtaagagtaaattgaaaagattgattgcatccacattattactctatagctttatggtcacattatttgatgatctagagcctaataaacaaagaaaacttctttggctagtttccatgaccatctttgttataatgacttaccaagttccttgcttctcccacaccttgcatttaggctggagctaattggctctcctttaaactttaattccaatttctggaagcaagtgcacccttctagacacagagaaataaacataaaatgtctaggtcaatttgtatatttctttaagctaacctcgctgagaatttttcttaaactttgctatctcagcttgtccactgagaaagcttactcttatggtctcagtacttagtactttctgggcgttcttttatttatttatttatttatttatttatttatttatctatctatctatctattttagagacagggtctagccctgtcacccaggctggagtgcagtggcatgattatgcctcactgcagccttgaattcctgggctcaagccttgaactcctgggttactcccacttcagccactcgagtagctggtaatacagatgtctgccaccatgcccagctaattgtttttgtttcttatattttatagagatgggggtctcactatgttacccaggctggcctgtcctcgagagagtctcccacctcagcttcctaagtagttagaattactggcacaagccactgtgcctggcttccaggtattccagattcttaaattccagattttctaacccagtctcctctgcccctttgaatttcatttctgaattcttccccatatgagcattctcctatttcactaacaagtttcgtagccccttcttttatagacacaaatctatttcctatgcagaaacagatatgtagattctatgtggcttagctcttcggtatacctattttgtatcttttttttagatatatgtgtataaagtgcatatattcttggttaaattaatgagatttataaattataggaatcgctatcattgtgtaaagtaaataaattgctgatgagagaatagaagtggaggtgatgcacatttttttgctaaaacttcttgcccagtaggtaatgtttaatctgaagagtatttttatgtatacataaatctggaaaaataaaccaaaaaatgaaatatcaattcataattgaataaagaaaagatactacaaagatataaaaggtaaaaaaggggaaataaaaagaaaaatcacgttgagtttcatttccctgatttagattatatttcaataatggaaaaaatatttctataaagaaaatagaagattctgagagcaagaagacaaataaaattccactattcaattttagtaaaatttattaattggttaagaattaagtattaaaaatagccaagaggaacttttacatatagtagtggtgtatttttacatgaatttaaacatacatggacctacttagataactttatagtggatctctgcatttaagctttcttcatagaaaatatctgaataattattttttaaagaacaagagagctatccattgacaacgcagattggacaatagagccacgtttttaagacatgctattgtgtacatattttgcccattgtttttttgctctgttgttttatgcctgtttaattttttatggaattaagaacttttagagaaagaaaaaggattctaatccataaattaaaatttttatcctggtaaatataaatacccatttaaattattaaaatataactggttgcatgtaaaccacacatagcaaacttgtcaacatgtagtttgtgaattaattccaagtggacactggagatctgaaatttctgcaactgaactttcaatctgttaaatagaaaatacttaatatactactgaagtttcatggagataatcacagtggtggcgatgagaagaacataggctgtaaagtagataaagtggggtccagatatctgtcttattcccattgtgtggcctcagacagatttatctaattgaaccatgtctcagttttctcattcaaatattgaaaggaaaatattaattaatccatgtaaattctcctagacaatttccagggttacatgttaattttcccctcctctccttctgtagcattctactcagtgatttccaaaatgtgatcggtgtcagagaatcttgaatgatgctcaaagatgaatatcagcatattccttgaattccctaagtgagtcatttctacttatatccatttgcatatgcatcttatgcatatttataaaatatatgtatatgcgcatatttttatatgttgatcagcgagaactacttctgttctatactaactcattattttatttttatgaataactggtgcccacgagacagtctattggagtaacgttaggaattatcatcccttaaagtaaaagggactatatagatggatggaattttattttgtatttattaatcctttttctcaggggtcattgtaagaggaaaaataatatgattcataattccacttattatagaattgcacatacataaaaaacaataaccagaaggttgtatttgtcatttaccctctcaccctcatggcactgcctctgtgatatcctgtctctgaggctctgtacttctttaaatggtctgtctggcaaccatatttttccggcttattaaaatgtttttcaccattgattataaagctcatatcatttctcccatgaatcctttctaaaacagctgatttcttcttgtttattgctataggaatttttgtatatgtactatcatagtattataacttgtatcccactcattgcaaaaatgtgtttgcatagtaaacttcttaagaaggaatcatttctctctcctaaatagggcctggttcacaggaggtattcaatatagttttgttgaataaacaaataaataaacaattggatatataattgaatactgtttcgcatttaagaaaaattgccaaactgtcagtctatgagggattacatagaataaacttttgcctaatttgtaagcatttcaattaaattctgattctattattgattcacttagttcctaatctattaacatgggtcactttgataaaactcagttttgcaaaacacttttgaccattaagacagtgtaaagctgaaaaaaaaaaaaaagtcttcctagaatcctattactctcaaggaaaattaacctattctactttggataaaacttactttttacattttcttttctgttctacacagtagtgacgataactatttaaatgttgagaaaataatgtgcttaggctactggactcattttttttgattcatgagtagctattagtttacatgagcacagaactacttagaaattacccctgaaaagagaagggagcatcatgccacctgttttgatatgttcaaatagttgagtcattagtcaggctagatgaatgggagcatagagaaaaaaaagacaagagaggtaagaaagatacaagaagaggccaggaagggtggctcacaccagcaatcccagtactatgagatgccaaggcgggtcactttgaggccaggagtttgagaccatcctggccaacatggcaaaaccctgtctctactaaaaatacaaaagattaaacaggtgtagtggtgcacacatgtaaccctagctactggggaggctgaggcagcagaatagcttgaaccctggaggtggaggttgccctgagccgaggtggtgccattgcactccagcctgggtgacagagtgagagttcatctaaaaaaaaaaaaaaaaagaagaagaagaattgattaataattgtttagaatttaaaagtataattcttagacatagatgaagaaaaaaataaaaggtagagcagaaaatatatggtgttcttcaaatttttccctgcaaattcttactgttttcctcttcctttcttagcttatatacacacatatttcttcttttactttctatgcgaagtgaaatataactttaaattccattatgtgatatgccagatctataatatccatcagataatttctatcatgtttctgtcccattaggttctctgagatccagcctgggattgcattttattcaatcttatatttctagcccttaaaccataaatacatggaattatgtacttatgaaaggcttcaacatcaaaatagtgaagttattaatacacacactgtcacatgtgtatgcgtatgtgtgtgcgtttgtgtttgtagacacacagtacatattaataaagtaattttccataatggcttttagtaactaaaacaaattttatacaatgactttagaaactaaacccacacatgcacacacatgattttacatgatgtcttttagtaaccaaaacaaacttcacaaaattactcttagaatctaggaatttgttatcacccctcttgacttccagctcattccctcctctcacccctctagaggaaagagtttgaactctttaccttatgtgacaatagcatggttatgcatgaaacatagtcctctgaaccaatttcacattattttaccttgcaaaatgttatcttaaactttttcttgccttgcaatatcttatacattaccttgcaaaaaaaactagtgtatttaaatattatgtaaattatgtagttgctaatgaagctcactgaatggtgtcttttatttctttcttattttgtttgttctctaatgtaggacataaacctcccttttaattgaccaaagtcttgctaatagaaacatcaggcattaagatgttttaaaaaatactttgatgtacttgttataagcatcaaatgtaataggaagaaattagtcccaaagtattaaaaaatcataacaagattatttttctgactttttttttcttttttccatttcttttttcttttcttttcttttttttcttttttttttgtttttagtcacagggtctcactctgtcacccaggtgaagtgtagtggtgcaatcatggcttactgtaaccttggacttctgggttcaagcaatcctctcacctcgagtagctgcgactataggcacaggccattatcactagttatattagtctgttctcacactgctaataaagacatacccaagactgggtaatttataaaggagagaggtttaattgacccactgttccacatggctgaggaggcctcacatcatggtggaaggcaaatgaggagcaaagtcacatcttatattgtggcaggaaacagagcttgtttagggaaactcccatttataaaaccatcagatctcatgagacttattcactatcatgagaacagaacaagaaagaccaacccccatgactgaattacctcccaccgtgtccctcctgtgacacatgaggattattacaattcaaggtaagatttgggtggagacacagagccaaaccatatcattccaatcctggccactcccaaatctcatgtcctcacatttcaaaaccacgcatgcctcccaacagtcccccaaagtcttaactcatttcagcattaactcaaaagtccagagtccaaagtctcatctgagatgaggcaagtcccttctgcctatgagactgtaaaatcaaaagcaagtcagttacatcctaggtccaatggaggtaaagccattgggtaaatacagctgttccaaaggggagaaattagccaaaatgaagggactacaggccccatgcaagttcaaaatccaacagggcaaccaaatcttaaagttccaaaatgatctcctttaactccatgtgtcacatccaggtcacactcatgcaagaagtgggttgccatggtcttgggcagctccacccctgtggctttgcagggtacagcccatgtcctgactgctttcatgggctggtgttgagtgtctgtggcttttccgggtgcacactgcaagctgttggtggatataccattctgagatctggagaatggtggccctcttctcacagctccactgggcattgccccagtggggactctgtgtgggggctcacatcccacatttcccttctgctctgcgttagcagatgttctccatgagggctccacccctgcaacacacctctgcctggacatccaggcacttccatacatcctctgaaatccacgtagaggttagcaaaccttaattcttgacttctgtttatccgcaggtccaacactacatgtaagtcaccaaggctttggacttgcaccctctgaagcaaggggctgagctccttttaaccattgctgggacacagggcaccaagccctgaaactgcacaaagcagcaagaccctgggcccagccaatgaaaccatttttttcttcctaggcttcccagcttgtaatgggaggggctgccatgaatacctctgacatgccctggaaagattttccccattatcttggcaattaacatttggctccttattacttatgcaaatttcagcagcaggcttaaatttctcctcagaaaatggatttttcttttctattgcatcatcaagctgcaaattatctgaccttttatgctctatttctctttttaatgtaagttccaattccaaaccatatctctgtgaatacataaaattgaatgcttttaacagtacccaagtcacctcttgaacactttgctgcttagaaatttcttccaccagatgccctaaatcctctctctcaagttcaaggttccacaaatctctagggcaggggcaaaatgccaccagtgtttttgctacaacacaagaagggtcacctttgctccagctcccaatgattttctcacctctatctgacaccacctcagcctggactttattgtccataccactatcagcattttgcccaaaaccattcaacaagtctctaggaaactccaaaccttcccacattttcctgtcttcttctgagccctccaaactgttccaacttctgcctgttaccaagttccaaagtcccttccatattttttagtatctttagagcagcgtccacttctggtaaaaatttactgtattagtctgttctcatgctactaataaagacatatctgggactgggtcatgtataaacgaaagaggtttaattgatccacagttccacatggctgaggaggccccacaattatggtggaaggcgaatgaagagcaaagtcatttcttacatggtggcagacaagaggtagggtgttcagggaaactcccatttataaaatcatgagatctcatgagacttatttactatcatgagaacaacatgggaaaacctgtccccatgattcaattacctcccaccaggtccctcccatgacacatgggaattattacaattcaaggtgaaatttgggtggggacacagagccaaaccatatcactggctaatttttaatttttattttttgtagagatggaatcttgctatcttcctcaggctcctctcaaactcccggccttaagcaattcacccacctcagccccccaaagtcctgggattacaggtacaagctaccatgcttgaactttttcttattttgaaacaagtaatatgcaaagacttaattttaaaacagatcaggtaattcttaattatctttttctttttatgtaaaaaccctcacagatgcaagaaaaaaagctatttaatcttccagcctcagtttctctatttgtgaaaagagagttgattggcctccgtgaagtgttttgagaattagtttatacttgaaaagtgaattcaatgtgaaaggtcccatttaaatgcaaagttattaatcagtgaatacaaaattcagcagttttattttagtttctaaactcctagcaactcttcacacaaaattctaaattatttgtcctttttactttccttaaaaatctttttatacacattatccagcctgcttttaaaatgtttgcaatatattatcctctttttttaataaagatgcaacttataaattcaggaaaatattttcccataaacatgtttttattttatttccccagtttccccaaatctctgttctttgcagcatctttctaacataattgattgcattaatgaagtaaccaactggtgactcaaattgtgaatctgaattgtcactccatcaccagtagatttgcagaaggaatgcaatatttttaacatattttatgaaacgttaactattatatttcagtgcaagttctcaagatttatatagatgctgctttcaattcaagagaaaatgtaaagatcatgcctttggctccaccatggagctgagacaagtaactgcaagctttaaaattgatatcttgaataatatgaatccaatcagtaaaaaacaccttatttataatttttctcaccactacgtatacagtgaaatatttataagaatataataggtagataaatacaaacgtatctcttcaaaaagcatgctatttgaaagtcaatttgtatttagatttttatttcgcaagcaaacaggagaaaaagatggatggattagaataatgtagagttactcctacatttcaaagttgagttttagaaaagtatttggaaaacacatttctctaaactcacttctgggttttattttttgttttaacaaaaacatcatttaattttcaaagaactgttctgaacttgggtagtttttgctctaccagaaatcattacttatatatgcctgccatgaaacagtgaagtttaaaactattgaatctaaacattactagatagaaaactatataaagcatccttatttttcaatgcaatttatacacaaatagataacttttgactatttctgaaaaattaacaaaataattctatagtgactcagtaaataaaaacttactattaacttatttgccatattgagtattcttacattcatccaccatttattgtagtcttacaagcacttaaatgttgagaatttaggatgaaaagacaggaatacttaattttacacatctgatcccttaaaaaacgataatctcttaattaatctttattctcaatagaaatgattattttaccagtattacttttcaagtgattaaattttttacattgctttaataaaagtaacttcaaaacacatcaacctaatttatatgagtgaacaacagtattaatctcattcactaactacagtcacttcttgttttggttgaaaaagtagtattttgattagcattagatatacttagtggttaactttgtatatatttaggtactatttaatttcaaaaattgctaataaagtcatcaagttattttgccttatttaaatgtttgcttccaacaaattagaaaaatgggtatttacttgattttttaattactttttattctgaatcttgacatctcctagagatagtccatctgctcacgatctccagacaattcaaggaaagaaacaaaattgtccacatcttagaaggctcaaaaagaaaaatagcagttaagatataatagcatcccttaagtttttaataataataataaacaataatattttgttcagaacaagttaaatattgaccagtaaaataagagctaaaattgggagttaatctaccctggggattcttcattatgttgaattcaaacattggagtgacttttcctccacaaatctgcttctgctgtaggcccttccttagttaagagtacaaaatgtattcccttgtacagttcttgcctgttttttctttctgctctaccatgtttttaagtgatcatctctttccatccattccaagttccaaatatgactcctacttacccctttcttccttctgcattgctcctgactcagatcaggtcttcctttgttttccctccagctcctctcctccatggtctacggaggcttatgctccactacctgcttgtaagtgcacatagttgccccagtgggccctttataaaatatcaataccttccactcaaaactgcttcatgtcttctttttccgacaccacctagaaagaaatctttatcttttgtttaatgctatgacatgagccaatatgtgtgtgatgtcatgccagctccctcctgaaagttaactgcctcatcccagaagatatatgctccatgttgtgtgagtactggtactactatttgcctagattattattttgtgtatattctagtgagactgcttataaatagaaagggaatggcttatttatcttgctatccaactggtgcttgagtcctggctcctttgtttaccagctctatgaattgagcaagatatgtgacgtctgcttcatctataaacaggttttaactaaaatcaaatgagtgaatgcatttaaaaatcttagaatagtagatgagacagcatgcaaaattaaaatgaatataattgatattgtttatgctattcttttatttatatttttctgcatctatcagtatatggctcagagaaggtactcaataaatattgttgaatttaaatgagagaagcaaggaggcttaattattcatcaaagcaagcaatgatcaccaacattattatcatcattatcatcatcaccttcaaacattcaacatgaacaaaatatgttagctaaacaaatgacaagacatactatttacatctacagtacttgtaatcaatatgaatattgtttccatatagccgtggttaataagtaattcagcattgtaaatttgcataatagcaatgtgttatgtgacaagggcggaattataaatatttttataattatatttacaacaaatatatgtcctaatgtttcatgggcaacaccagttttaaaaacggacattcacccattgcatccagcaacctcatagcacataagatacaggactttaatggtattgataattcagttctgaacataggtggggtcaagacaggtgttcataacattattttatatatattttgcatgtctgaaataatttatattgaaaaaggaaacatacaatttcatataacattttccaacaacaatttccgtcctttctatgctgaagcagcacaaaattccaagtggaggataagaaaataaggggccaataactttactagtcaacatagtcatttcagctgacctcaactgatttattgaactttaattcaacatttatctctatgaattaattgttactggagctgtaaaaattgataaatatgacttcttttttttccctctttttcttcattggtctagcggcttattcagtatgttctgaacacacaatggctaatatgaattaatggttgaatataattacatgtgattccatcatacaaaattattgattgacaacactggtttaatattattgaaggaaatacagatttttaatattttgggatgtaacttttatttagtcagagacgagagttatatgcaggctcacttgtttacttttattaatatgcatgctttatgaaatcctggtactgcatctctccctgtgtaaactacttgtccattataccatgctctaaaaataaaatgcaaaagcactccctacttagacagcaggaattaagttttctgattctaagtagtggttttaggacaggaataattttgtgtgttagtttaacctgttctctgcttgtatgctaacagctctttcttgctaaagatcatatcgactgaactgaaatgtataactcatatactgtaggtacagactaaggaaaagctgaaaggataagggaaggaccttttttgactcagctcttcttgctcttatgtcctgctttataatgtttcctttctctggaccatcttccccttccctgaagctaactccttaccctggacctcatcatctcatgactgaattattccatagcctcttgattgaaatctatatttctggtcttttcacaaggcaagccatattccataatgctgacgtaggaattctgtaaaatatactattgtgtgtgccagttccttcttacgtgcttttaaatgattctattgcctacttgcagaatgccaaataggttccaggtgattaccagctccagtctacactcaggcttacctagagtgttgtgtggaaatgatcgtgagtgtggctttcagaattacctggaaagagggcattgattgattagtgatgtctgcaacagaagtagaaatgggaacttgtagcctatacagagtggattcaagaactgttccaacagagtggaatctactctctcaacattctcaaatggaatgtgtatgtgcctacacagaaaaaaaattacgatttgaaataatcgtatgcaatattcatgaaaaaggacagtatatagcactgtttccctagctgtgtgaattacgaggtgtgtgttactagttacacagtgcaagctacttaacctctctatgactcagtttcctcatctgcaacgtgtgaataatagggttcttataaaaattaaatgtgtaaatttatgtaaattatttagagaaatgcctgatgtatagcaagtttattcaaaacatgtgctcttatcattattattgtatcttaaaacagctacagaagtctgttatacaccacaccactttgagaaggaaacatttctttttgataggctttattttttagaacagttttaagtttacaaagaaattgcagagaaagaactgagagttcccatatagttcctctccttgctgcacacagtttcccctattattaacatttttgcattagtgcagtaaatttgttaccattgatgaaccaatattaataggttattacttaccaaagtccatagttttcatcagggttcactctgtgttgtacagttctgaggatttttacaaatatgtaatgacatgtttctatcattatagtatcatataagacagtttaatttccctaaaatgccctgagttccccattttcatctctacacctttccccaatcccctgacaactactgatatttttactgcttctgtagtcttagcttttactaaatgtcatatccttgaagtaatatagcgtgcaacttttaaaacagtcttctttcacttagcaatatgcatttaaggttctttcatttttttgtgtggttgatagcacatttacttttatttttacaagtcacttgagtgttttaattaattaattactttgtttttagtggttattaattttattatctttttaatttcttcaaatttattttagattcaggcggtacttttgcagatttgttacctaagtatattgtaacaagtgatgctgaggtttggagtacagaagatgccgtcactcaagtactgagcatagtacctaaccgtttttcagcccctgctcacctccattccccaccccagtcatccccattgtccattgttgccgtctttatgtccctgaatacccaatatttatctcgcacttacacatcagagtatgtggttttggattttttgaagaaaattgttgaaaatatgtttcttaccatgttttcaccaccatatatacttacatatatagatatacatatatcagtatatataaatatataaaataatgtatataaatcaatatatataaatgtttatatgtatatatacaagtgtatataaacatagctgtgcggagaaatttcttttgacaccagagaaacaattgtcaattattcgacttcctgccacagttaaaatttaattaaaaataattaaatactaaaaataaaggaattgtttgtggcggaaggaagaaattggtgttctaacgcaagaggaattacgaaatgacacctaggtaacatattaggcaccatcctactcaaggcattgacatttactattttctttgcttgaaatgctcttccctaagtatatttttggttatgtcttctccattaagactgcccagtggtcatcactatgagaacttgcacgtctattctcttgctaaatgcaatgcccttggtgcttcataccctgcttctctggagacatcttagggtgtgtgattgttattcatggaaactgtcagttttcttaagtttataaagtcactttatattaaactatatagtctactatacattatttttatttattttctgtcttcccacattaaaatttaagatctatgaggacagagaactttgttaactgctgtatccacattgtctaaaaaattggcttacactttttaagagcataagaactatataaaatgtgactaaagggtttgctatttttgctgaaatatatagacatttttagttgtttgaatgaaaatatcacttttcattctcccacaccatatgtaggggtcttgattttaccactggaggcttgaggaatggagtgggatttaataaataggcctttagttttaggaaatattttgaaattaatgtgtagctgtgttagaaaacctgtgactgaagattattcaacaaataattgtaatcattattatattaagttattgatacacacaaatgcatccttttattatttaataaatatttggaaattttttttgaggaaatataagatttaaagtctatcccagaaaatattcacacaaaaagtcatggacagatctctggtcttatttgatagtgtctgatgcagtgaggaagatggctgaaggtgaacctgacctcagctatattctaccttgcacaaggacaaggtcaggggaaaaggtaaaaagctctggtccctttttcatcaataaaaggcccttttctggagacatcattggatgtgtgattgttattcatggaaactgtcagttttcttaagtccaccctgtaacaggatacatgagtgacagacagtggaccattatcttgacaaggtagatctttgctagcaaaaagtcaaggtaaaagtaaacctaaaataagagagtaagattattatttttgaattcagtgttacttatagctactgtaaatccaaaatgcacacttgtattttaactgttaagactttcctttcctggctcatattttgccaggttatccaaatgagcgtgaaggaaaagaccaatcattcaactgatgatttaatggtaatatatgaggttttaacactgtagacttcatattaaagggattgtatttcagtgttttgacattaaaagcagtcattatagctgttgaatatattgtttttatttctccccaagtaatcttttctataaagtatgttatcaatgttaattaaacagggaccataaagagtccttaagtcatttttagaaaatgtcttcaaagtggttttataatactagttaatatatgcttataatctgaagaaaataccatagttgctgtagaatatagtaaatgaggtaccgaacaaatggtcctacacattctggattgaatatatatcattgttaaatgcaggaggttcaacagagactgttatatggaatcacatcaggaagaggtgagggaaggaggactgggcagagggaaaggctgaactgtgttgtggttgcagcacgtatttcagacgattggatgagcagctctgaaacagactgtttttcagatttatccccagtaaggcaagggatccaagcctttgcactctttcaacattcaaccactggttgtaagctacctcccgaaggacggtggtgggataagggtgtataacgttacaagagacaaccttctttattgattgacaatttccagagcgaaagatgtcgctctacgccacaagcagccaacattcctgacaattgggaaaatgacagtctcagtccaaagaaggacctgggtgccaaatcacagcatccattacagtccacttattgcttcaagccgtgagtttaccccatctataaacagcttccttgtggtttaaggtggttcttttccaagggtaacttacaagaggaaagttaataagacaaacaaagctcataatggtgctggtcctaaaggcataacttagtacttaccatctctcttctctactacctattccagattcctctcgctatttgtcagcacattgcctagtctaggtggctcacttggatgggttgcccaaatatcatctttaaaagatctgagccctggtcactgtggaatcctaattaggcaaaaggagtcaggctggtgggagtaggggaaagcgaagacagaaaggagataagctacaagtctgcctttcttcaagatccaggacacacagccctcctgtgcaagtaactcacaatctctctgtgcccaactatcacaagacacctgcaagttagctcactgcaaccttggcattatcagtactgcagaaagctctctttgacagacagcataaacactaacctataaatctccagcaagcctttgtttctttacagtcagtcagtttccggcagcccgttctctctctggcaacatattttcctactttctctaataaatctgccttcctttccctatagctgtcttagtaaattcttcttttacccccactccatcagctgtcgttgccccgcaacagtcgccaggtacttttcaggctgtgacagctgcacctgtccatttgctgttataattagacacaggagtatgaagaaattctcctatgaatcattagggtgccaaaattactatttctgcctctgatgatcagggtcagctacctacaagacagttcatcctttctttgacagctagtttcctggcataagaagcacaaagtgactggaagtcagcaacagcttaaagtttaatagtttcataaaagctctggcagaagcgtacccttccttttgagaactaggtcttctagacatgccgagactagaagtaccgagacaagaaacaaattcaagtttgccactactatttacttccacctttgtttcacagacccatgcattctaaatattacaattgctggtacccagccctcacaatctgtcatttattgccaccccaaatttttctccaaaagtttgttccatttgcactactaggccagtagcttctaaatggtatggtaggtgacaggctagagagattccatggccatgtggccattgctccctccatttctttaaagtggatctcttgattccatgggatgttatgtgggataatgtgttggttgaaataatacttgcaaggcttacttataacataagccttcagatagttgctagttgagacagtaaaggcaaaaaaggaaagcctacatttgggttcatcccagttaaaatgaactgctgctccttctagggtggaagaagtcctatgtaattgacttactcctaagtccttattgcttgtaggttggacatttgtcagtgacagtagctagtttagcattactgagtggaagctcctagagttaagctcatgcatagcctccatgcctgccccctagctacagcattaattagcccatgacagcagtgctgggacagcaaagacagcctccgctgatgacagtttgccaggtcgtttgatatagttcttgtacagtgccccttccatagtggatatctctgatgggcattaatatgctatacagatagagtcacagtttgtttgcactctcattgatccatatatatatattttttttttttttccttcactagagcttcctgtctgatattccaatattcctccctctgggaccctaacagccacactattttctatcgatgataggtctatatatattttcttacctcaggctatcttcttcccacacaaactggatgacctgttgtactgcctaaaattctgctaattggaaagaattctcactactaaattttagaattgccctgaattgtacaacagcagtctaattatggtggtttcccacataccaaattatcccatccaaaaaccaggcttgaacgtgtccacttttgtcagataggtggagacacaggcatgaggtgatacaaaggtaccagtgaagcaggggtgggtggtatggatatcttggtcacatctttgcatactttacttggatccttgttcttagccttgcctgtgcccaatcccagatgtaacataaacatagtacggacgattcctgccgaagccacctggtcctatgacttggtgaatctgataaaatccagctcatattgtaagctctggtagcctggtacatggtcgcttgctgtcctatggtcaagtgctgctctaccaggacctactagccaccagaattttttttttttttttgagatggagtcttcatctgttgcccaggctggagtgcagtggcacagtggtaaaatctcggctcactgcaacctccacctccttggttccagtgattctcctgcctcagcctccagagtagctgggattacaggcgcctgccatcacgcctggctaatttttgtatttttagtagagatggggtttcaccatgttggccaggatggtctcgaactcctaacctcgtgatccaccccccttggcctcccaaagtgctgggattacaggcatgagccaccatgcctggccagaaattttttttaaaggagagtattattttctccttcagatccagtagcttagaagctacatggcgatcctcttattgggttttgtcacgaatgccaaacaacatcttctttttaaatctgggatactttttatactataatatccaccaggttatgtaccttgagaggtaagactgcttgcgccactgcctagacctgctgtgttcctgctctgtgcctgctcagagatggcactcttgtttgccaatcagtaatggttagaccaatattcccaaggggtatatgctatctcaagaatccaggacagcttttcgggcattgtgcttctattttagtggtgggggagatgagatctgataatttgctagttactctaaaggtatgagatgtagcaatgtgctctttaccatggcattcttggaacatggaatcactaaaaatctcagtgatatggtgggtccttgaaccttcataggatctttttttctcctattttctggagcttatatgtctcataataaatgtctttaccaagctagtcactgactcatccatataaatttgcatggtgttgatgctatatagtcaagtggatctgtgtaatgtagtgaagaagtctggataggacagtttgctttggactgtattatcacagagcataggagacttaatacagcctgaagcaagaatgtcaatatatactattctgctttccctgcagatgtgaacttctgttccttttgttcctgatgaggatggaaaaaatgcatttataagattaatgggcacatattatgtacctgagagcatatttacctgctgcagcaaaattcttttgatatgttcataaaaaataagccaactaatttcctctcaaaaaactaaaagacactgaaaatgttataaaataaactacataggatccacgaatgatctttactaaatagaacatcatcaaatattgaaaatgctgtcatgtggaaaaggaattgaactgatactgagtgagcacaaggcataaaatcatgaccaatgtacagagagatggattttatttcaatacatggaggaattttgtagctgtgttgtacaaggatggaatgggtgacttgcgaggtagatcattccctgatattgtaagtcttttaacaagagtttgacagcctctcgaagcatgtagttgtggtacaagctgcagaatattttgtgtaagtgatttttgagaatactttcaatgctgaggttatataaatctaacatattctctacgggcagtgataatattcagatattcacttacatgttcattcatttgaaaaacatgtattgagcatttgcagtgtgctagggctagggatgagatatttttgttggctttgtttccttcaataactataataaaaaagtttctgctatttgggaaatacatcatactgtcaaacaccaaagagactttgaaccttcaatgttaatacgtagttatgtttgcatttattcatatacacaaatttaatatttcaaatatgtatttcagttctttccaaaaaataaaaaggtaatcatgaataaaatgttttaagacctcagtactagttagaaactggctaattaaaaatattcgtattttaatttggaagattctgctaatgataatatataatgggggtatatctccatgtatcgtgagtacaatttttagaatctatttgcaaactcctctttaccagctgtcttagtccgtattgtgctgctgtaacagaataccacagactgggtagcttataataaacaaattaatttttctcacggttctggaggctgagaaggccaagatcaaggtcctggccattttggctggctggtgagggctgctctaggcttccaagatggctgcttgttgtcacgtcctccagaggagactggtgtgccctcacatagtgggaggtggaagggcaagctagccacacgctaccttgaagcctctttttttttttcttttatttaaggggtacatacacaggcttgttagatgggtaaattgcatgttgttgaggtttaaggtacgaatgatctcatcacccagatattaagcagagtacttgacaggtagttttccaatcctcagacctccctccctcccacttctagtagtcaacagtgtctatagttgccatctttatgcccacgtgtacccaatgtttagctcccactaagaagtgagaacatgcgatacttggttttctgtttctgcattcgtttgctttggataatggcctccagctgcatccatgttgcagcagaagacaagatttttgttcttatttatgttgaagcctcttgtataagggcctttatctcattcaagtgaggaggagccctcataacccaggcacctctcaaagcccccaccttttaataccatctaattggccatcaaattttaacacttgaattttgaaggggacactttcaaatcatagcaccagctttatggaaaaatactacagttatggtgtcctttatgaactgcaacagacatatccagcctttgttttgcaaggaattcccagtgaagtcccagacaaaaaaaaaaaaaaacaaaaaacaactgttcttaacatctttataagcaagaaaatataatatatatttagaaatcttgtttaatgtgatgtcaacatttctttttttataacatttcaaaatatttaatttttatcattttactttgcactcttcttacatggttcctgtttcatgaaaataggatctttcaaactgtgcttttcttaacattatgcatataaactttccaattctctgggaaactccttatagacatttaaaatttttataaagatgctttcaatgactattaaatgttatcagatcattttataacatttccccttatttttgtttggttttatgtgttgtatgtatatatatgtgtgtatatatgtatatatttgtgtatatatttatgtatatatgtgtacttatatgaatataagtatatatttatgtatatatgtatacatatatgtatataagtatatatgtatatatgtatacatatatgtatataagtatatatgtatatatgtatatataagcatgtacttgcatatatttatattttacctttaaaatattatttatactatattccttttatgaattttttatctttcatcctgaaaataggactctttaaccaagaatttatagatggtcacatggaagtttgtgagcttcctaaatttgtatggaaacattatgtctatattcatacttttctaaagagaggatctgtttatctttaatcaaattttcaaagagttccacactgcaaacaagaaacaattacataatattattctttactcaatatttacttccctgtgtttttaacttttttattatattttaacttctgtagtacatgtgcactacgtgcaggtttgttaaatagttataatgtgccatgttggtttgctgcacccaacaactcatcatctacattaggtatttctcctaatgctatccctcccctagacctccaccccacaacaggccccagtgtgtgatgttcccctccctgtgtccatgtgttctcattgttcttctcccacttatgagtgagaacatgtggtgttgtttttctcttcttgtgttattttgctgagaatgatggtttctagtttcatctatgtccctgcaaaggacatgaactcatccttttttatggctgcatagtattctgtggtatatatgtgccacattttcgttatccagtctatctttgatggacatttggattgattccaaaactttgatattgtgaacagcctgcaataaacatatgtttgcatatgtctttatagtagaatgatttataatcctttgggtttatacccagtaatgagattgttggatcaaatggtatttctagttctagatctttgaggaatcgccacactgtcttccacaatggttgaactaatttacactcccaccaacagtgtaaaagtgttcctatttctccacatcctctcccgcatctgttgtttcctgactttttaatgattgccattctaactggcacaagatggtatctcattgtggttttgatttgcatttctctaatgaccagtgatgatgagcattttttcataagtttgttggctgcataaatgtcttcttttgagaagtatctgttcatatccttcacccactttttgatggggttgtttttttcttgtaaatttgtttgagttctttgtagattctgggtattagccctttgtcagatggatagattgcaaaaattttctcccattctgtagggtgcctgttcactctgctgatagttccttaatttctctttctttgcagaatctctttagcttaattagatcccatttgtctattttggcttttgttgccattgcttttggtgttttagtcatgaagtctttgcccatgcctatgtcctgaatggtattgcctaggttttcttctagggtttttatggttttaggtcttacacttaagtctttaatccatcttgagttaatttttgtataaggtttaaggaagggatccagtttcagttttctgcatatggctagacagttttcccagcaacatttattaaatagggaatcctttccccatttcttgtttttgtcaggtttgtcaaaggtcagatggttgtagatgtgtggtgttatttctgagacctctgttctgttccattggtctatatatctgttttggtaccagtattatgctgttttggttactgtagccttgtagtatagtttgaaatcaggtagcgtgatgcctccagctttgttcttttggcttaggattgtcttggcaatggcgggctcttttttcattccatatgaactttaaagtagttttttccaattctgtgaagaaagtcagtggtagcttgatggggatggcattgaacctataaattactttgggcagcatggccattttcacgatattgattctttctatccatgagcatggaatgttcttcagtttgtttgtgtcctcttttatttcctttagcagtggtttgtatttctccttgaagaagtccttcacatctcttgtaagctgaattcctaggtattttattctctttgtagcaattgtgaatgggagttcgctcatgatttggctctctgtttgtctgttattggtgtaaaggaatgcttgtgatttttgcacattgattttgtatcctgagactttgctgaagttgcttatcagcttagggagattttgggctgagaaaatggggttttctaaatatacaatcatgtcatctgcaaacagagacaatttgacttcctcttttgctaactgaatactcttttatttcttgcttttgtctgattgccctggccagaaattccaatactatggtaaatgggagtggtgagagagggcatccttgtcttgtgccagttttcaaaaggaatgcttccagtttttgcccattcagtatgatattggctatggatttgtcataagtggctcttattattttgagatacgttccatcaatacctagtttattgagagtttttagcgtaaagggctgttgaattttgttgaaggccttttctgcatctattgagataatcatgtggtttttgtcattggtcctgtttatgtgatggattacgtttattgctttgtgtacatcgaaccagccttgcatcccagggatggagctgacttgatcatggtggataagctttttgatatgctggtggatttggtttgccagtattttattgaggattttcgcatggattttttcagggatattggcctaaaattttctttttttgttgtgtctctgccaagttttggtatcaggatgatgctggcctcataaaatgagttagggaggattcccgccccccccccttttttttgtttatttggaaaagtttcagaaggaatgataccagctcccagctcctccctgtacctctggtagaatttggctgtgaatctgtctggtcctggactttttttgcttggcaggctattaattattgcctcaatttcagaaccttttatcctggcctagacttgggagggtgtatttctccaggaagttacccatttcttctatattttctagtttatttgcgtagaagtgtttatagtattatctgatggtagtttgtatttccatgggataggtggtgacaccccctttatcattttttattgtgtctatttgagtcttctttcttttttctttattagtctggctagcagtctattttgttgatcttttcaaaaaaccatctcctggattcattgatttttttgaaggtttttttttttgtgtctctatctacttcagttccactctgatcttagttacttcttgttttctgctagcttttgaatttgtttgctcttgcttctctagttcttttaattgtgatattagggtgtcgattttagatctttccttctttctcttgtgggcatttactactgtaaatttccctctacacactgctttaaatgtgtcctagagattctggtacgttgtgtcttgttctcattggtttcaaagaacatctttatttctgccttcatttcgttatttacccagtagtcattcaggagcaggttgttcagtttccatgtagttttgtgattttgagtgagcttattaatcccgagttctaatttgattgcactgtggtctgagagactgtggtgatttctgttcttttacatttgctgaggagtgttttattttcaattatgtggtcaatttgagaataagtgtgatgtggttctgagagaaatgtatattctgttgatttgtagatgtagatgtctattaggtcctcttggtccagagctgagttcaagtcgtggatatacttgttaattttctgtctcattgatctgtctagtattgacagtagggtgttaaaatctcccactattattgtgtgagagtctaagtctttttgtaggcctctaagaacttgctttatgaatctgggtgctcctgtattgggtgcatgtatatttgggatagttagatcttcttgttgcattgacccctttaccattatgtaatgcccttctttgtctcttttgatctttgttggtttaaagtctgttttatcagagactgggattgcaattcctgcttttttttttctttccatttgcttggtagatcttcctccatccccttattttgagcctatgtgtgtctttgcatgtgagatgggtctcctgaatacagcacaccaatggattttgactctttagccaatttgccagtctgtcttttaattagggcatttagcccatttacatttaaagttaatattgttatgtttcaatttgatccttatattgtcattatattgctagctggttattttgcctattagttgatgcagtttcttcatagcgtcaatagtcttaacaatttggtatgtttttgcagtggctggtaccagttgttcctttccatgtttagtgcttccttcaggagctcttataaggcaggcccggtggtgacaaaatctctcagcatttgcttgtctgtaaaggattttatttctccttcacttatgaagcttagcttggctggatatgaacacttctatcctgaaactacttctgatgttttatctaaaagatgagaaaacattatttgaaatatcacctcagcatatcatgaaaagcaaatgtcatttaagaaagcgtgtaacctatgattttaaaattaatctggattatatctattttacaaaaggttacattaatttcagcaaaatgcacagacttttgtctaatacaatgagctcagatgttaaaattgcagagacatacattcatttcacagatttgtcagtagtagctgagtgacttactgcaagttcctttatcctcctgagctttggttacttatctttgaaaagggggtaattcttactaaaagacagttggttacagaggttctccaagtattaaattagataataaatgtaaaacatgtttaactatgtacctgacacataaatgagcacttgtcgaacagtattatagatggtataatgaaaattatcattagtaacaataatgcattattattactaaaactttaatcattaataatctagtagtggttttaaaggcttaatgtcttggatcaagatactttgagtttagctgagggtaaatgtcaccatcagattagattagagaggacttttctcctctattttggggaatagactgactattacattacatgcaattctttttttatttataagcactaggaatggaattctcaaaccaacatctttattttatccaatgctcttaaattaacatatgtgtacttactataatagagtagacgtagctcttagggactattcaaaatagaatagtggtacattatttatggcattagtttccatttgttactaaaagcaaactttacacatgataaactcaaggtttttatgttttgattataaaattggtgagtttataaaataaagaataatagaatacatgtttatgggtagttaatacttagatttagtaattaaattttcacaaaataattttacaaatgtatcacacagttaatgtttttttctaaatttataaattacatgcaattcttactgtgatttacaagataaattttatcataagtgattaactaataaatgagatctcactatcagcatgcttttctgatttcattctgcctatgtaaatgaaactttatagtagagaaatttttaacatctcagaaaacatctttatgtttcctgttttgatcatcaccataacccttgaaataggtataattttcccattccacagttctacaagatgacaggcaggatagtttcatgtgttttcggggtcattcagatggtaagtaatgcaaatggattttgaacatagattttccttgtcccagctgttcttttcactgccgctatgttgacggcatacaacttcttaaagcttctcaaagggggatctcaaagatatatttacttatcttggtgtgaaattaaaaatctcaactcttatgactaaaataatattgtgtaccagaattattaatgtaattcataggcatttcagacatgattaacatgagcttctatcattttaagattttatttacttgtttatttattataaacataatcaaaactgaagtgtttagacagaatcacatactgaacagggaaatagtgagtgttggctattgcatagaatttgacagtgctatatgctgatgactttatacagaatgtattagtgttaagatgcactgcatgtgaatttggttttgccatttgtccctagttactatctctctctctcactccccaccaatactttagcacatctatccatgcatagtaatagctccctatttcatatgacaaaatatttttatgagtattaagagacagttaacattttggctgcatagttatgctgatagaaattacatgtgtatatgtgtgcaaatatatacaaaaatatatagaaaggaagagtcaaattagatcctcaaagacttccaaaagaaaagagagcagaaatactttacatctgaaatcttgtgaacttgagtttgtttggataatagaaagatggctcagtacaggttttagaaagactagcttgtcaataaaatttattgagcatgttaacgaatggctagctatgaaccttcaagttgttcagataggatcagaaggcaaggatagctaaatcagtttagcctttcaaaatgtttgcattagaagtttgagaggcctatatgcagttagttaaaaatccattgtgtcttacttgcacaatatggaacaggataatttaaattcttataaactagtaatgtttggaatcttttcatttgcttttgataattgcttttagagataaatacgcttgaatagcacaaaattaaatacattctttgctttggtcattaagtgcttaacataattatgttaattaaaactttataatcagattttctgtagagatcatcttttccagtgtctaaagtgctgcctttggctgcatttgatgctattaactcttctgctttctaatgggataaggaattttgcaaccgctaatccaacttcatctttttggccttatcaacttcatttgatgaaactgatcactcccttctctttgagacagtttcttcacttgacttcattttgcagcactaaccactacttaactgctttctcctgatctcctcaagctctttttattggccacctttgctcattctctcatctatatacactcacttccttaagtactctaagtacttcttcatttatatctccaatttagattccatgtactcacttactcctgcagaattccaaagtcttatatctgaatgtttagtcaatattttcaccattagcaatgtcaattcgataattctaaaatgaacacttgattgtgtcctttaaactagtttctctgaatttcttcccatctcagcaaaagacaaattcaatttagccagtatttggatctgaaacttggaatatgttgagtcttccctctcacatcctacattcatttcaacaacttcaatgcagtttcatagtcagaatattctgataatattttaaccactttcatcatctccattaccctgatgcaagacatcaccatttttggattattgcaactagtctcgccttgcttcctatctaccatgtaatctatttcctgcattgtcaccaggatcatcttgttaaaaagtaagtcctatcttgtccgtctctaatcaaggcccttcacttgtgaaggctgagtgaaggcttcccctctgactcagactaaaagccaaaatctctacaataaattatattaacattattccctactccatcacctctagatcttaggtccattattctccacactcagggccctctgttctgagatcccaaactcctacctcagggcccttcacttgctgttctttctatttagaattcaatttctcatgacatccaatggtcaattccttgcttctttcagatatttgttcaaatgttacctactcaggactgtccagtatgctttatcagaaattacagttgatttttgaacaacaagggggttagaggcactgaccttcagcatagtcaaaattctgtgtataacttttgactcctccaaaactttaccactaatagcctattgttgccagaagccatgttgaatacatagtcaattagcacagattttttatgttatacgtactatatacagtagtcttacaataaactagagaaaaatatgttaagaaaatcataaggaagagaaaaatgtatttcttattcataagtcctcatcctctttgtcttcacgatgaggaggctgaggaggtgccggaagaggcagggttgattttcttgtcaggggtggcagaagtggaacaaaatctgtgtagaagtggagtctcatagctcaaaccagcatccttaaagtgtccttcgtacaccactgtaacttttgggattctatattgcttttcattttcactgctttattttcctccatgtctttttttttttaaaacactaggccccacaattaatatatttttgctgtggattgtctgaagacaggatttttttgcctgtggtgttcactatggtatcttcaatgcctggattatataatatactcaatatatgtcttgttaactgaaattagtatgtttcagaagggaaaatgttaaaacatttttggtttatttattgcatattcataaatatcttgcctgaaaaagattgtgtatctaatatataatgtgtgcatggcgttctttattttctctttctccaaaagagaaaaagtagaacatgccatgtgtcattcagtggcttctttagcatgtttcactggcttcgcttattcattgtatctccttaaaatgttcgccatgatattttgtattgagctattataaaaatatattttctacaaatttaacattctctttattaccatttgatctcatcattccaaaaattatttgaatttttcacttgaaataaatgaatgtaatttacttgttcgacacaagcaaacttgtgttgaagttgacatgcaaaacactctttctaaaatgatgcaagtattttacatgaaaagataaaggtcaaatctaagattaaaatctgatatatgatctacataaaattataattatatgaactaaaaaatacagaattatatttacataatgtgtaaaatataaatgtatggttacattactgtacccccttcttcatactccacaaaaaaatatgaatagagaggatttcaggttataaaactagactatcatctttccaaaactcagcttttttgtttagctcctttaatcttctcacaaagacagaaataaaaaagggagagagagagaattaatacctttgtcatggaaagaaaatagtaaaatattagaaaaatatggtatagtggttaacagcgtggaatctggcacaaaatgcctgggattaagtacatgccctagcatttgctagcacttatttgggaaagatgcttaccacttacttgcccttgttttttaaactattaagtggagatattgatagaaactacataattaaattatttataagattaaatgacttggccgggcacagtggctcatgcgtgtaatcccagcactttgggaggccaaagtgggtggatcacctgaggtcaggagtttaagatcagcctggccaacgtggtgaaaccccgtctctactaaatatacaaaaattagccgagtgtggtggcgcacgcctgtgatcccagctactcagaaggctgaggcaggagaatagcttaaatccaggaggcagaggaggttgcagtgagctgagattgtgccattgcactccagcttgggcaacaagagtcaaactctgtctcaaaaaaaaaaaaaaaaaagattaaatgacttaatgtttggaaaagacttggattacatgtctggcatgtagtaagtgctaaataagtgtgtgataactaaataaatgggaaaagaaaatattacaataagatatagtatactggtagaggaaaaactatttggaagtatattttattacttagagtttaaatttcataaggtaaagaatcttgtctagttagaaaatatttaggtcaagtagaaatagcctccttctttcccttttagtatttgtcactttttaatttctaccacatttaattgcaagcaccttttaactcccttatggcgctgaaaattcaaatgttcatctctgtatcctctgtcaaacagcacctgaatatatatagaaatggactcagggctcttttggtaaggaatttagatgatagtgactgggtaatatcacaattttaatatgtaatttgattcttgtttttctttatagtgtagtggcaaatattgaaatgccagaggaaaaaaaatggaagactttagtaatgtatcttaattatacaaaatgaattgcataatttataatttaaatgtatttttattaaaattgctgtttagtacatttatctctcctttttcattgcagaatgcttttgttttcagaaacaggtaatttagccaaatacagagtaataagaaagtagtctaatagtttatccagaaagaaaactttcaagatttttcatattccagggatctctatcagataaaagaagtatgaatgcatcttcatttctacacacattatctttatgtgtatagatgaaaatgaatgaaatgaaaataaacactaccatttcaagatcaaagataatggatacatttcaatataatttcttaaaaatttaaagttactattttataaccttaaaaataactcaatttacattttctcttacagtcttgttattatatttaacaacaaaatttaccaacttacaactctaaagtgatggggtaaaaactcataccccaaagtttgttgctgatgacattcgtttggtttgtgaaactacagactttctccaggcattatcttttcagttgtaaaccttttaaccagttcatatgaaaatatctgctaacacagcaaaatcatgagtgcatgtctttcaaattaagttccattcatgtcatcatgtttttaaaaatataaggtaataaaagtctttctaccctaaagtaaagtctttcactatctttgtagcaattgaactattctactgaacccaatatatgaaaacctttccctactgctcccctcatctggtttctaatctagttaggccttctttataactccctacttctgtgcctttgaatatctaaagtggattaagaatggccacacattctccgtcaaacttttcagtgagatgttcattttatcccctacctccacctcatccttgaatctgggcttgtccagtgtctgctccctaagagaggctgtgccagttccggacttagcttttaagaggacttgacagtttttgttttctccctcttggaacacaggttcttgggttgctctctcttggatactagctaccatggtatgagaagctcaggccacatgcaggggccatatggagggaagctgaggcactccagttgacagccccatgaccccccagctgacagtcactgccaactgtcagccatgtaaagtagccatcttggctcagcccattcaacctcctcggcctcagcctgcgtcacaggaagtgtaaccacccagctgagcctattcaatgcacagaatcataagagagatagcaaaataatttgttttaagtcgctacattttgaagtagagagataactaaagcaataaccttctgcttccttaaatatagggcttaaatttggctcaatttaaggttagtaccaagcacctttggtaatttatttctattgtctttatgttgcattttcaactagagtgtaagttattcaaggtcactgaatattgctgttttctttccaatgtgtccctatagttattagtacattattagcagcatgggactctgataatctgaggttgccagttgaatcctaacagaatggaagtgcaaatagggcatagaatgggtgactttctatgtaagtcaaaatgtagaagaccatgtccatgtgtattctatatataatatacacatatattatacatataatatatattatatataatatatatgatatacacatatatacatacaacatccacacacatttatattggcatttaatctggattatctgagcaaaaaaattaactgtcgtctgaagttttttgtttgtaaactcaacctaaaatacccattttagctagacacattgtcatctgttggtaatttacatgaggaattgtgaaagaataccagactgaagggaaaagagaaattatgctctgaatcaaaaataaataaataaattatacagaaaaggagaaaaagctaaagttatggtctggaactatgctataaaacagaagtaaacatagtaattttctcctttcagtttctaccatgtattctgcgtgtacttgattggggaagtaatagtaattaacgattttctctgaatgggtgctgtatgcaagaccatttgctagtttaacaacagtgaagcatgtttcaactcaacaccctggattcaacaaatagaatgctagtatgtctattcctgatccaagactattttttaaggtattaaaaaacaggtattgtttaaaatgtgagagattttacttttttaattccaagtgcacttttgagttattttactttgaaaattaataactgtatcagtacttaaaaatatatccaatataattaaatgattctccaaatttatttccttgagcacctgacaatattcccaggaaacctctccctgctatgttgcttcccagaattcacatttctgtgtttcaaaactgcacttccttagagagaaaaaggttagaaaataacgcagactacaaaaggcatagtgtatgtgtgggggtgggggtgaggaattaagtcccttgcactctagattaagttgcatttatataaaatctaaaggtaattggtctttatataaaggacacattcaacaacatttattaaatatatttttagactattttaaaattcaagtgattcacaaaaacaaatattacagcatagcgctttattcatgccatcatacagtcgatctgtattcttcaagtacattttgaatttataatgagaacagtttaaggcataactcttcccactcaaatctaggtctttctcaagtgagacactagagagagtagaaagggaggaagagatagggcgagaagaaaaggagggagggacagagatgaggacgagaaagaagaaaaaagggaaagagaaaataccgtctgaagtccacaggcttatctatcccaagcatgtctaccccacgcatgtgggcatcatatccaggttgtaacaaagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggctcgggggatcccctctccctgggaccggccctgtcccgggtcgcctccacctcccgcagccgccgcgccccggctcgccgcgctcccgccggcaccatggaggaattcctgggacaaccgcctgcagccggcgacttttccccaggaatctctggcctggcgccctttgggtgagatgacggggtgctggcatccctgtcggtcccagattacccggaaaagccctggcaggtaaagagaggacccgcgcaggctgggagctcccactcctcctccagcgtcacgctcgccctccgccgctgcctcgcgtccgggtctgtttatatagcgtctggaggccgggaggcattgcccacccccgccaggcggcccgccctcccctcctgggctccgggctgccgcacgtggcagacaccagcgacgtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttcctgacacttgaaggggttgagccagttcctctcagttctgtctcctaacccgctccaccccgacccagccctcccacactaaggaggtggggggcgaacaacaacaacagcaacaaaaactcccagttacctaagtatctagcaggctgttgacttttttataacttacctttagtcaatgaaacgaccatatttactctattgctttatattaatggaggtcaatgggcttaatgatttctttagtcaagtcatttatttctaagccaatagataatgccttcgtcatagttttctggggggaaagtaactgtgcgtttgttctgcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggtaagtgccacccagagaaagatcacacaaggattggtaaggcagtgatcctcgcgcggggactcgagaaagccggtgtgggatcgccttgggttttcccccaagtcttgacagagctgattattacaagactctagagactttggggtttaagcaagtagatgttttaagattgcagccagtaacatcgtgacatgtacaactagtaaagaaggataagacaggtcaagaagaagagaagataatctttcaccattggtcttaggttgattttgacttgaggtggatgaaaggtaactgttcagctatggaggtgggagtgggtttggtgcaagtttaatgacaaggataggtttttgctttccatttggcatgcatgtctatgttcaggtgaattgggccaactaaatcattaagattgtgaagtggttctttaaaaatcaagctatggttttcagtattttggttgtaaattttgcttagcaacagctttttaccctgtcgaaacttaaagtctctctttcgtctcccctgttgctaaggtgctgccatggggcacacaggcagagttattaaggacgttcattccgtttcacagtcgcttgataacagtatgttgctaacagcttgctgtcatattggaaacacccatactaaagatatgtagtataatatgttttctttctacttaatatgtaactcattagtatgtatatacctcatgacttaacatggaccaaaataactgtgttccctggtgaacaataatgcaaaatagacttcccaaaatgttgatgaaaatcaatgttgtcgaattccttgtttgttaataaataaaatagcttccgtaattaaacgtttaacaacagaatgcagtcttcttcatgatattgataaaccactttttcagttagtcctgtgcatcaccttggaatattaatattcttaatttcaagggtcatcacccatgaacactctgtaccttccacacatagaaaatgttgaagtagtccattcctggaaaacagcaatatatagtaatggccattaaatatttgctcttatacttaatgaagtttaattttctttttgcacagtggttagttgtgcaatataaagaggtaatctgctttttcattatgacaagaaatcattaccagtctctaaactttaaagagaatgagttgtccatggatttttagtggattgttatttcgaggaaaaatgttgacatattttcatttagttgttaatatttattatcctttctaataggaattcaactttggtttgaagtatattctgttttgtcattccagtgaaaaaaagaagatggacactttggatgtgaaactttttttgttcttatttacatcattcaacccttgatgtaaaacaggattttaataactttagtagtcaatatgctattatgtaaaatctccactccatgctggtaaaacaggaaaggcaaaattattttttcttgaaatttgctaattcaattaacaataaccatctgaagtatttgctggtatagctaacataaagcgctaattaattttattaatgagattcttacaactttcacattgactctataattttgacccttaatgagaaaattgtttgtctaatagcagaaaaaaaaaactgtgacagtttaactctctgatctgtcattataataattgactgtttccttatttctggttcttctgtagtgcaaatgatacttaatttcaggtaataaagtaatgggtataaaagacatggggtggcaagagaattttcgtatactgtagaataaataactgaaattgattgatattgtatgacattccagtttaataactctatgtagaggctttgaaaccaagtggggaagaaaataagccccaaaatgaatgtcagtcatctactttaatattacctaaataatggttttaaaactaatactttttatagattaaaaaataaaatttaaaaggtaaaaattaattgattacttaatgaaaaatataattcactgtaaaatagaaacagttcattttcattggttttattctattatttattataattagaaggaaaattaggatatgttgtcctcaataagcaagttttgggtaagtaagagttaagtcattaatattgatattggaacaaataaaaagcaacttttaaaacatgcttaatattgtgatgtaatatttggctaatgtatgtgtatattgcaatgttagcaaggtggctaaacacataggttttaaattgaaacataatttggctactgggtaatatgttatttctatttagcaattaatttttaaaggacattttcatggttaattgctaaatgttccccagaacacatttactactatacttctccccaagttgcaaaatattgaggatgaagataatgtgcagatcaaagcactgacagcaataagtactgaggctagtcaaacaagtcacatgcccaaatgagtgaactatttttacagtacttatgtgtaaaacagccaagggttctagttctgagtatcatgtggtagtggtcataagagctgaaaaacttgcactgttttaaatagtttaattattagaaaaggttacagggaaataatttaatttatggaaattcaaaattatggaatggctaattcttttaaaatatacgttatttatattttagcagatgatatcactaataatttttctatctagtattgagtacaaattgtactaattctgcaatctgaagtaaataaaataaagggaagtgaaacaggaaacactgatgggaaccatgtggattaattttcacaatgtttagtatttaacactttttttctctaatctactgtctgattacacattaattgtttgtattttctagaccttcatttaaaaataatatttaagataattttctaatattttaaaatcttctgcatttatgttgcagaaaatgaaacaaggacgtaaaaattaccaagttatttatttcaaagtttttctttttcctttactctcagaaaaccaaagaggatcgatataacagttttaataacatgatacaattaaaagttttttatggtttgggatctgcaaaattgaaatcaagtcactgaaataaatatgaagtttttgagattttaagattttataaaaattatatttttaaatttttatttagatgttacattattataattgtgatgtgttattttcaattgacttaattttgtctttttttgttattgggatgatataagtatctcctttatgtcatttagaaatatatatgtatattaaaagaatctactgataatatatttagctgagaatgattgctatatagtcattgtaaagtaattcttagcttcatttttctgtttaaacatttgaaatgctcctcttctcttgtttcagctgtatttgcattaaataccacttacatatttaggtcataagctgtgagttaggatgatacatagaataatactatattttagaacaaaactactatatccagtcttattgtatttctcttttcttaatcacttattcaagaatatgtgaaaaaaaatctagcaccaaatactttcttttcctaaatacatttttaaaaaccccaaattccaaaaaaagtaactgtaatagtagtttagcaagtaacttggaaataatattaattacagaaataattcaagaatatttagaatatgaagaggatcttgcaattttttaaataaaaatgagggccaaaatcttagaattttaaaacagatcagaactgttcagaatgattttagaagcttatattgtcctagattttctaccacattaaaaaaaaaaaaaaagcctaggtcctctatgtctctttgaaattgtggaaccctattatttatttgaatttcagaatttctatttttaaagtaggactcttcgtgtgtgtcacataacaagatgaataaagtcctgagagctcacaccttatatatggaaaatattgtggggtaatgcattgtttctgtcttgtaaactgtgcttgacagatatgtgactttacctccattaaaaaaaaattctgaaaaggataccttagcatctttgtctaattcatctaatgttaatcagccctacactgcaggggagccttctttttgaacaacaatattttttccagtggcttttaaaacttgttttataacatgaaaataagaaaatatcagataattggtacccagtgtatgcaaactgtcttaggcattttttttttaacatgctgatcactaaagctgtaaaatttatgtctgtgttccttttttagcaaataccttagaatttggaagagctaaggacaggaggaaaaatttacacctacactcaggatggcacattatcaatacactagatatgaaaggacacattagtttgagccacagtggtcttaattagctaagatgtagattttaaattagggttttaaaggaccgtttctggaatttatggaaaatgcattcagaatcactacagggtggcaccacacggaacactgtaacaagtatcttaattatttgctgtgacctggtagatcactacatgattagttcatcacattgccccatgggagacagagtgtgaaacacagtcttctgttcacaatctggtcaaaaaaataaataaataatttttcccctctattcatttctgagttggacaagctgtgctgaatcaattagtttcctataagttttccctgcaaaaggagccaaatcaagttggaatatataggaaaagggtgagaaaggttgagtggtttaaacggtgtagaagaaaggattgaatttttttgtttgtttgtcaggagtagccgtgacaacccttagaaagtttgcagccatgtctctccttgcaacatttttatacaaatgaaagacagctgagggacatcaacaataacattacaggcagagataaaacttaaaatcatgagaaggcatcagaagatgtaagtggaatatagaatcagacttagatatgtttcgtgcatcatgtattcccatttctcccttgattggcttgcttatggggaagagttttagctctggaaacatcagatctttaaaaccatctaaggagaccatgttcttttcttttgctcatatttgcatgtgtttacaaaattactgttattaaacaaaggtgcaagtgtgcaaagaaatggaaggttctgaagatgacagtaaagacacactgtcctaaacttgctctccttatcacctcactgtacagctaatgatttctaaattatctcaaaatgtagtcgtaatgcttgaatggacaacaaaaaacaacagataaaaaacctgtgtgctatggaaatatgtacttagacacataaaatatatctatatagggttcatttaaaggttgtaaagaaggacaagcattcacaaaacttcaaggcatcatgacctctaactttcttcactaatgtgttgatgtctgtcactgcttaacaagcaaaatggcatcagaaagagggtgaacaaataaaggtatatttagggctaatgatgaattcaaggtaaagcacatcaatgtttccaccaaggtttttgcttccagtgtggtagggcaaaaagatgtgaactgaattattggtactctcaaattaaatgtattcattttattaattcatttagcaacagacatacacaggtacatatacccatatccgtagtttcacttataaagaaaaattaaatccacccaactgttttgttttcagcaatatttttaacttctgtgactttttgttttttccattgctttgaatccacaataggtaggtaggggaatttgaagcaccattgaaatgaagtattctagaaaagtatgcagaaagataaagaaaatgcatccatctctagaagtgcttacatctacttagcaagtgtgaaactcacaatgaggatttagtctgttagtatggcacagattataaataggagagtcgctgttataatgtaatataattaacacaattgttcttgttatagagcatgatagtagctaccacctgtcttaaggactggtggtttctcaataagggctaagaaggccaattttgaattatttcaagtattcaaatattcatggactatgatttcaatacttgaaatctagaaatccagagaaaattataataattttgaattttttcattatattaaaaatgaccaaattgttaggtatgccacataagttttagtgaggtggcctttccttttccctcatatatttatttatttttccccaagacaaggtcttactctgccaccccagctagagtgcagtggtgcaactgtaactcgctgcagcctcagtctcctgggctcaagcagtcctcctgcctcagccttccaagtagctgggactacaggcaggcgccatgatacctggataactttttaaaaaattttttttgtagcgacaaggtctcactatgttacccaggctggtctcaactcctactgtcaagagatccccccacttcagcctcccgaagtgccgggattgcaagcatgagcccccactcccagccttgtgcccttatttctgacatgtctccccagctggaaaatccaattgaacttaaggagaaatatcagaatttctgtagtattgggtcttgttctcttttaggtcagagtgtagtctctagaatcaaattatttaggcttaaaaattctggcttagtatgttgtgacatttaagaacttatggctcttccctggatcagttttcttaattagtaaaatgcaggtgatgataccttttttgtagtgttataatgaggattaaacgcttagcatctttaacagtatataacaaggcttaacggatatatatatatatatatatatatatagttattacacacaagtgtttataagcaatcattgcctttaccaaggtaattagtgtttgtttaataaatatttacagctggcttctctttcagaggcattgtcaagacagcacagcagagcaacgtcactggtgtgttgaatgtagtagggaggactgttgaataagccaatagagtcttagaaactaaaagggcatttttcttaacattttggatttcatacttaaggataagttgattattttaatttttttattgtttattacaaaaattactaaaattagttcttgatgtattgtattgaaaactatccaaaagttgaagcttttaataaaaaagaaaagaaaaaaggcaatatttctttgtagtgactactgtcatttcctataaaaataaagtccatgagtcaatataagcatttttttttcttcttactaattacaggcaagaaactgagaactacttttgttgttgctgtttaaatcttggccatgagtttggctggattattcgaggagaaaaaaagttaaaaagtagaataaaaactctcaaaatcattcagccactttatggagttagcatttttttcagtagaattaggggacagataaaacatattgcattgtgcctgttcttcttataaaaattacacagggttggcattaagcaaaggggagttcagatacttcaagtttgtaggtgggcctcatcccttacagaagtatgtaactgtgggcatgctacttaacatctttaaacctcagttccacacgtggaaacacaaaaattacctcataatagggtagctaggagaaataattggattgtatgtttaaattgcttggtacatggtaaataatgagggaagctttacaaatagcaatctatactttcttgactttttagaacgtccattgaaggtagtaaataaccttaaatattgtgtacacctaaaaaagatataataaaatacataaaatctaccactatcaatttttcttttattgttgataccatatttttggatatgcaatatgtgcaccatactgggatagacccagagggaaataagcaattaaaccataaacctgttttcaattaacttcgaatctattagtttaaaaaggcatatgtacactttaatataaggctggattacatggctttacaataaatacatgctcaaattatttagagtttagaagaggtaaaaaatatgtaagttattgtgtgatgattgtatgtggtcccactctaagtcgtctgtacctttaggatttaatcgtccaccaaattcattgacaggttcttctatataactgaattcacaagtaaggaaggcacaaagacagaatttgagtccatgagctctggatttatagaaaaagaaactaattggcaatgttaacagccacattgtttaagggtttcaagatgtcattaggcttgataatttgtccctggtattctcttgattatagttacacacaattgtagaaatttaaataaaattatactagattaaatggtaagactaaatatttaactaaaatatcttatatttttaagacggataatggatactggtgaggtcagcattgatctaaatggctggatgtgggaccctggttggtaagatacaagtcaggagaaggctgatgccctgagagattgaggggacagtcccaaggagaatggaggtagtcaagtgaaataaagcaaagagagaagcagcaatggttattatccaaaaggcaaatttagagtctgtgcttttaatagtttgaatgtttctcctggcagagatgtctgagatttttttcccatgcaaatatcttactactttagagaggtaattaaaaatttctgaaatagtctataaactgtgaatatatatatatgtatatatatatacacacacacatatatatatatattatagatgtcttagctagaaagatgatagatgggtaatcagatatttattatagtttatataatcttatgaaaaagactgacgactataatactgaaaggagatgtcaggaaaccatacagccaccttgtcaataagtaagcaagctacctgtcaacataaatgctgatgatgaccagatacacagagtgaaggaaacaaacaaataaacaagcaagagtgtacttaagcatagtatagtaagtggggatagatgggtgggtggtggtacttattgcaactaatatccagttgccaaaaaatattaagataatatattcataataaaaggataaagtgattataataaaacaacaataaaagtaaaaataaaagtccacatattaataaactttaaggtcacatttattgaacttctaacatttctctgacactgtattaaactgctcttaagtcctcaacacaaatccattttatatatatatatatatatatatatatatatatgtaaaatattactatcttatattacaaatgcaaagagattttaaaaagttgtcaaggtagtacagggatttttctatcaatatcaactattgagattatatgaagttcaccatatattacaactgcatcggaaatatcctaggtcattgcaacaaaagaaatggtataataatttaactgtgaaagtcaatatgcacagtggtgaagggcatggacactagctccagactccctggtgttagttccagttccattatttaactactcaaagaccttggacaaattacttatcttccctgtgtcttagatttctcatttctaaaaagagtataaaaagagtgtctaatggatttagatggtgtaaggctttaataagctaatctgcataaaatgcttagaaaactggattgaacatgataagcaatttaaaatgttatctattattacttgttagaattctagaaaattaagattggaaaaagagaaaaagcatgttcctattattacttgttagaattctagaaagttaagattggaaaaagagaaaaaacatgttcccacacactttctttcatgaaccatcatgaatatgtttccctttttggatacatttttgcatttttatttttattttttgtttctagatccatcaatgcctcttgatatttttgcattttaaagtagtttttaaaagtgtttgaatcatgtttaacttcttctttcactttttaaattcttgagtagcccatacagaaaataatacggcacttgtttcagaagtttttgtaacttgaaccaaggtctcatgtggtcccacctgtcagaagcaaattagatttcaacagagaatgtagctcttcccagaatatgcaatgaacaacgaatgctattttgatgacctttcccctcatatttttagttctgttcttactacatggtgttaatttctgaacatgtattctgccctcagggaaaaaacgatcttttaaattgtgtcattaaatcagtctagttgccaaagacaattctcaaagaatgtctttagggctgaatactttattatttcatctaacttgagttttaacgttgttgttttggttgcatccaacagtcaggtagaattggaaaaatcaagaataatgcggctggagaccatagttgagtaacttgatgaaggaagtgctttctcacgccctcttctagtgcttccaagaaaccagctggccggaaagacaggggaatggaaagctgtgtaaaattaagtgatgggggaaaataaaaatgcttctgttccctagccgagtgaattttaccatttttcagatagcctagcagaatggtgtcagattaacaactatgtaatggaattgtcccccctcttaacttacgtagaaacttttaacttttctttcacaagccaaaggaaattacatttttttggaagatctttggcattccacgacaaagatcttgagttctaatatatgaaatacagagaggaaaataagcatcagggaaaccaatagatagagttcaagaaaagtgcagaaatataagcaagtctatcactttacacctcttctctcctcttcccaacttcttagagccttttcttttcctccttttcctttaaaagacaagtttcacatagggactgattggatcaattattagcccgatgaatagatgaaagatgagacacttcaaaaacttgaatcttttgcttcgtaaaaaacattctgttgaacatcaccgtgtttccaactattagaatgtgtgtgatgtgagaaatatttttcagctcaagtcttctgctattgctctttgttgtcattggtttgtctgtaatgctgggacctgtcagtttattccaaactacgcaaccagaaagtaaatatagcttagttgtgtcaccttaacagaaacaatctttcacaagttaaaagtataaactggtacagtgaaacataaactacctgaaaagaatcattccacattttcctattcagctctcttcgtcgtttttggaaactgctttttccaatcttctttctctcttcaaatctcccgtgccaccacctcttttattatgcttggtaggtagccttccttcatctttcactgtgagtataggattttcatttggggagaaccacgactcatgtcataaaaccagaaagcactgccatttgcatgggtgttttcccaattctctacttgcctcctgttactatggaaaaacatctctagctttaagataaatatggaacctctatccagactatgaatcacaactttctttaggaacgtccacatattttgtttttcttctcattcatttattttcagccttttcctctcaaaacatccctcacaataatatttaaacatgctgaggtttctccccctattggagggggtaggggagccattcctgactttccgtttctacccacctcaggctgaatctgactcctgctaatctgcattaacccctttcgccaatatcatcagcaatctctagttagttgtttcaaagccgcatatcattagtcgtattacttgttagaaattagcttaacactcctacggaaaacggtcttcttcatctgagaagaggtggtgaggtaggagatttgaggggagaagggattggaaaaagcagcttttggaagacagaaaagagagtagaacaggaaaacatcaagtggcgtgtgctggtaattcaggcttctcggtgcacacccctattttaattcttctgtcttcactgccattcccaaccaacacccataccacgtacatttaccagtatcctttacagactcctacttgtgttcttttcctaaaaatatgctcatcgggagtgtcaaccttaaataatgagattcagaaactattaagtatagagtttattcaaatgcaaaacttgagaacagccacctggaaacatggactccaaatgaatgggatcagtgttccaaagtggagaagttaaggttacactttatataggcagagataaaaaagttccaacaaggtcacatttgccatacaagactagtgcatatgccacagctatttgattgattacagactgctacattacaaggaagattactttattactctgtgaatagaggcaatgatctaaggggatcttatggctgccacttaattatttacaggaaataattaattggtcttaattatttacaggaaaaaggtagaagttgcaaccgcatgctctgtgactcagggcgcatagccatactcttctcaaggctcagaaaatttaaagttccaacaactttaagtttgaattatgtaatttcacaggtgtttgtacaattacttcttgttctgcactctccctgggaccatcactcacaagccttcagaatttcagttatcaaatttaggttgttgactcccagactattttctctaatccaaatttccctccttacgatatgaaccacatatgaagctaaaatctagaaacagatatttgaaattatagaagtctgaaattaaattcctttcattccctatacctttcctccttctctgtatcttatcttatcttatctaaaggaagtaacctggatactattccagcattcaagctgaaaggtgatcactgtcttcggtaccttcattatctttactctcagattcaattgaatgctaagtatagttgacccttaaacataggtttgaactgcataggtacacttacctgtggatttttttcaataaatacattggaatttttttggagattttcagaaaatttgaaaaaagcttgcagacaaaccatgtagtctagtaatataaaaaaagttatgttacaaatgcataaaatatatgtaggtactagtctattttatgtgctaccataaaaatacacaaaaatctattataaaaagtaaaaagattatcacaagttataatacacttacagaccatacctggcaccattcacaatcaagagaaatgtaaacaaatataaagatgcagtattgggttataattgcatgaaattaactgtaatacgtactgtactactgcaggaatttcatagccactccttgtgctattacagtgggttcaagtatcacgagcatctgcttaaaacactgtgcgatgctaatcacttggagaagtgagcagttcatctgtctagtaaatcgctatctcagtaaaacatgatatcacaattctctcatatttctggccatgcttagtgtaaaaccataaccttgaatagcaccatgggacccaaattaccactagtgatgctggaagtactcccaagaagcagagaagagtcatgacattacaagacaaagtagagttgtttgatacgtaccgtagatggaagtccacagctgcagttgcctgccacttcagacaattcatcttataaacaaacgaaacaaacttatggtattgataaacacaatgcagtacgctacatgtcttttctcttcctcatgccttttttgttgtttgtttgtttgttagatggagtctccctccatcgcccaggctggagtgcagtggctcaatctctgcttactgcaacttcttctgcctcccaagttcaaacgattctccggcctcagcctcccaagtagctgggactacaggcacatgctactgggcctagctaatctttgtatttttagttgagacagggtttcactatggtctagttgttcgagatcaggctggtctcgaactcctgaccacaagtgatccttctgcctgggcctctcaaaatgctggaattacaggtgtgaaccaccatgcccaccccctcatgactttcttaataacattttattttctctagcttactttactgtaatagagtatataatgcacataacatgcaaaatatgcattaattgacagtttattttattggtaaagccactggtcaaaagtaggctattagtagttaagttgaaagttacatgcagatttttgagtgcacaagaggtcaatatccctagccccagcacttttcaatggtaaactgtactagcagtgcttcctacaatgtctttcttgaattcatccacgtctcgttacaccccttgtgagtgtcctagttgggatcaccttaaaaactttactggacttctgtgagacaccctcagaaggatactctgccaccagcttgctctcaagttcaccctcacagcagccagagctgtttatccaaggtgcttaactgagcaggctactccagtcttaaatctctttattggactcttacagcttcagataaaagcttgttttctttgatacagcttaccccgagtcttcttgatatgcacccacatccaattgatcactatttcactgccaagactccctaagcctcaaccattttgagcttcttttagtttcctgggagtatcatactttttccccctggaatttgaagacattttctctgcagttttgcctggttaatttctacttttcgtcaagcggtctctgggaaactttcctaatctcccatgtttgcattagatacaacagtttgatgttatatcttctttttctgcccttataacggtacttatcagtctgaatatcaactacctgttcaggtagtttattctctattgatcagtaagtttcttaaacatactagtgggtagaatggtggcacctaagaagatatgctcatgtactactccctgaaacctgtgagtattatcttatttggaaaaatggttatcgcaaatgtaattaatttgaagatcttaaaatgcagaggtcattctagattatctgccctaaattttgggccctaaattcaatcacaagtcttcttacaaaagacacactggggaatttgatggacagattaaaagacacagacagaatatgtagatgagatatgaagacagaggcagagattacaatgatgcagtggtaagtcagatagataccaaggagaaggcaatgtgcagacgaaggcaggaattagagtgatgtggccacaagccaaagaactcaagaaatgccaacaaccaccagagctggaagaggcaaggaaggattctctaatagaacttccagaggtagtgcatccctgccaacaccttgatttcagatttctggtctcctgaactgtggaagaattaacttttgtagttttaagctgcctagtttgtggagattggctacagcaatcccaggaagctcatacaatcaggaattgtctatcttttttcctctttttacttagagtgcttagcattatctgaccacaaattaagtacttgataaatatttcttgaaataattaagtgtcaaaaagttgtcttttacatattgaatttatttgagttgagctatatgtatacaaaaaaataagagtatacacaatcaaaatatgtataaatatcatataggtactgccaaacaaatatgaatataagcaagtaaacagttgtcatactcatgaattaatgttccatttgcatatttttgttctgtcaaccttatcctgactaaatatgctattatgtcaagacttgactgatcttgatactgaacattgtaagatttcatcagacatattgacctctgactatgctatagaagatatggattatttaaataactttattaaaaagaagactgtcacagccaaataagccaatgataacataaataacaaaatataaccattgaatttgctctttcttcaattatgcaatttctgttgtataacatttactataaaatgtgtaggcacaatgtgtgtttacatttaaataactaccacggcaatttaggaaaagcttatttttaaaactttactaatctttaaaaaaagcatgtggttgactgagttcattaatacacaatacaagtgaccatgaagcagcacacttcattaaaagaagtaattttgggaatatagactgatatatttcaaggggcttattttaatttgaatgcttcagaccttaagacttctattggtttgattctccagcacaagtcctcctttgaacaacccccactctttttaaggaaatctaccttgagttaggttcatttgaattagcagtcacgtagcagaaacgtagaagcaaggagagaaagggagaaaaatcaaaggtaaaacatgcgaaagagattaggaaaatttataggagctggaatagatatgacaagctttatttggtagaggcatattaaatgcagtgtcttggggaaaaatgtcttactgttatgataattaaataacattgtgtttggtgaaatgattctacaacttttctcataatgctaaattacatcaagcacattaattatatctcctcttgtttgtactagcactacggtcaacttttcatttttaaacttttcattctgacatttctatctactttttacctagctttgaccttctttcatttcacttgcttttgtgttcatttcaatagtgtatgaaaatggttttcaataaaagaaggtttattggctagatttaaatagaaaaagatgttcagaagtattagagggagttgtttaaattggttctttttccttaatgttaccagctcaaaggcattcattaataaaaatatcatttacagatacaattaaacaaaaattatacatgtcattgcacattgttttgtatcataatatttgtatgctaaaacataactttctaatggtgttacctaacaaaaatatgtccttgggtatcattttaatattataagaaaatatgtggatacacttttaggtaactaccctgttttggacacaaaagtatttttttatttttaatactttatatgattgtatgtggttcctgtaagtatatccagttacatatttctacttatttgagacacaatctgtccttgtcttatggtaatatctttgatctggataattgataaatttattatattttatgtagttatacacaatgccaattccctatgatattttccatggaaattggttttcattttcattttactgatgaaatgtaaagattctaatgaaattttttaaaataatgtgtttttaaaatattatcattcaggtaaaacagtcaaatatttgccaccaatatttgctattattataaatataaaatagtaatctgatctatatatgttttcagtcttttaattttttttgtatctcaaactttaaattgggcaggatattcctatttacaattatttatctcatgaattaatttatttaatatgttcttgttttcatatctaccttttattgtcttgtttatggcaagttttggatagtatttttcttccagcactagtgacattgaatagatagggaggtagatagataggtagagagatagatagatagataatatttctatatctacttatataatttgttccattgtcaagaacaataggcatgtgaatacattgcaaaaaaaagtatagagtaaaaaataagaatataaaataaaataaacttatcatttctcattttatcaaacatcatattattccctggtttattggttttatttgagtaagtacaaagtattgagccatgactaacaaaaacatcacttaagattcattaataagattgatttttattaattatgagcccaagcaaaagagtcataaagttaaaggataaaaggtaagtaggtctacactagctggtggtaagcattacacgctgccaactgtgtatttctagacaaacataaacattcaataagcttccaagtccttccatcattagagcaaaatgtttaaattaccctcatttgattatacatcctggaagtcagagatttgtgaacaatttttccatttttaagcagccttaaatgctaattttaatcaatataaaatatcatggaatggtcaaaacctgattttgatgattctaccctaaggcctgtttcacgtgtggcttgattagtgctgtactaagcaatattaaaagtatgtaaatggacaaaattatatatgatatctagggtatagtattaaaagcagctttcttttttatgaatgtgaagtaaagtataaattgcttatcataatggacaagggatgctcaatgaattgctattgactggtgtttaatattttttatgaatttatattttattataaatattattgctgacaacaaatggtatctgtgaatgcattcttggtttttaaatatcttattccaattttaatttgttaagcacactttatgtttagccagaagtttttgaagatgctaatattaagaataaaatagaatcagaggaaaaatgatcttattctctcattaacaaccaaaatacctggctaaaatcttaattattatgacttttcagtcattttcttttctagtagtagattctgcatttttttgagtttttatggtccagagtcatagtcacattttgaatgttatgtaaaatttgtttgtaaactatggtaaaaagaaattttatttccactcttctgctcttctggtttcttagcgtattgtctaaatcataatataatgtccgatttctgtattgttaaattagccttggtgtatgggtttatattagcatagactttgagctatggaataaacttttggtccagcctgttaaaagaaatatattcaaataggggaattattttagaacgtgcttatatatatattttatttttcctatcaaatagctacatttctccaacccataattatcttcatcttttttaaacacactgctctagcaaaatcatttcaaccactgtttgaaaatacggagcaaaatatgcaatgtgatctcctttttataacagtttgcatagatgttttcatgtttttgccacaaaatgagagacttctttctttgaaaaataaaaaaaaagatttcacttacttattaaaaaaacattttttaaagccaagtcctcatatttcctggctttgggataacatttggaaacctgtttgtaagcagatgctatagtgtaaaacattaatgcttatatttcaggaaattatgtgattctaagtataagtattttcaattaaatacagtacatttgctctcacggaattgattgccacttcaaaatggataaaataatcttgcctaagtttctcataagtcagatgaagaaactaagtgaatgtattggccaaaaccacacaatgagttaacattcatgcctcagtttagctcaagtcttaaggttcctgagactcatggagttttccttattacaacattgctttgcgatggtgtcactagtacatctctttttggaaatatcacactggaacttgagattgattggcctgataaatttaggatactgaccctggtaaacacttcaaatgcctttctttgtaggaaaataaacataatggcatgatgtagggttttctttacatttcatttactgagaggatacaatatgtagtggttaatagattttacatttaacacacatttacaatatgcgatggctaatagattttaggaagagggaggaaacactagtgcttgaaaagtgtggatataccatctaaagatgtgtccctagaaaatcatgaaaagtgctcttttctatcaatggcacaggcaagaggggtaaaggacgagaggcgtaagtcagacatgcttagataaaagactcgactagtggctacagagaaaactgatgaaccagggggaggagtactttgttgttgtcttgtttcagttttcccctagactgtggaaatggagttattgtaattgaagaaccttgtagagataacatttagccacaagccacaatatttcatagtagttagcaaaaagagtgagaggcatcagaactaaaaacaacacctagttttaccacttattgacagacaaagaacattctccatgttcttcttgccatctctctctgattgaattttgaaagaaagattgacaaacatatcacttagaaatgaggagtaaattcaaaaggatttatgaggtcataagcacattttgtttaattttctatggctttctatttttatttctgcaagaaaagaatattaatattctactttgaaaaatatacaaagttctacagaaaaatggaaaatttgtttctaaggtcaagtaggatttttggctttgtgtgtctgtgtatgtatatgtgtctccgtgtatctgtgtgtgtctgtatgtctatgcaaatgtatgtgtgtgggttttgtttcactgtttattgtttaacattgttaggtgctagattattttacatttttatttacaactatagtttatttataactatagcaatagtttatttataactatagttttataacctaaatgttactcaagctctaaaatatattacttaggcagaaaggctattattatgtataatgtaacatttaatatttatagtggtcgagatcattatattgcttttttattatttatggatatagcattaatttttaaagcaattgacagtctctaattattcaaatctagagaaaagtgaaaatagtcatgtataattcattaataaataagagcttaaattagctttctatattgttacaagtatatgtctacaagtgactgaatgttaattacttactaatggctaagtacattttatgacatatcttatgttaaagacaacctgtcagatttcttttactattagtgttctcatttttaaataataatagttaacagtagtgataatggtttactgtaaacaaaaataaaaaaatattttttaaatgttattgtaagatagggtgcaatcaattgatagttgaacgaggtagaaaaatattgtctgtaacatctatacaatcattagattttatgtagtatttggagctgaagggaaaatgatactatcacttagccatacagcatcataaaatagtgctagtaatattaaaagtaataaaatttacttcctcaatgctttctcctagcatcctttagtagtgtggacactgaaacagttaatttgatatcagaccctcaagaaaatggggttgggctagatgaaactatctatttttaaattatataaaaatagttggcacatctgattctgtatcccatctttttggcaactacttcacactgcttccaactctgcactgctctcagtcacatccctttttcatcaatgtagaggtgagctgatgaactttgggggcaacaatgaccgttaaacagttgctcaaggccaagtcagtatatttttattttaataattatttattaagaaatactttagacaataaaaagatatgaaagaatagaatgataatatttctactatcatctttgcaaatacaacagaaaaaatataactgaagacaccccagtccttgtcatgtaccacacactatttgaatgctcctcctttctagttctccaacatcatcgtaaatatgatatgattgtattattaattccctgaaatgttttcagatttttaatattttgtttcgtatcccacagaagagttttcattgtttcatgttaacacattcaactttttcagtcttctttcgtgattgtcactgactaccttggagaggggaagttggcattttcacatgagagttgggtgatggctatgatggaagatggtttaaatacaagcaaatagatcaaataagtaaatgttgaaggaaaaggaagctaagtttctcttcattatagaagagagttaatatgtcaagggaaaaacctagaatgaaccctaaggtattagaatggaattggagaaatcaatgtgcattcatgttttgtaatacaaatataaacacaaaatgaatatatatgtaaatgtgtgcatataaatacttaataattacaaaggggaaaagagcaattttacaaggaggaatattggcagacaccacaatgcgtaaatgacaaaatgatcactagtaatagggcaaattgaaattgtgagccagctgattggatgcaatgaaaatgtgttataagttctgtggtattccctccaaagatatacaacctgaatcaaatagtgaaacagcagacatgcccaaatttatgcatgaaataactggcctgtaatcttcagaagggttggcatcaggaaaatcaggaaaaatctaggacgtaatccatactgaaagaagctaaagaaatattacaactaaatgcaaggcatgagagtgaactagatcacatttgtataaaggatattttggggggcgattggtgaaacgtggtgggatctgaggcttaggtgacagtaatgaattggtgttaatatcctgacctggattgctgtattgtggttatgaaggagaaggtcactattcaaagcaatgggacatcttgttagcaacttcatactaaatggttcagaaaaaaaaatatataaatacatattatatattaatattatagatattaattattatatattaatagtaattgatatataatgtatatatttatataatatattaataataaattaataattaatatataaatatattatgtatatttatatgttatatatatttatatatataatatataaaaccacttttctgaagtttaagtttaagattgttttaaaataatgtaagggggaaaacgcccatgaggatagccctaattatgcagcacatttcccatctagaaatatttacccaactctcctacaaaatcatccctgagacattactctcaaaactccagcaaaccctcttttatctttgataggttggcatgttacattactaggttatgaaatgagagtcatatattcttggctagtaggaagctccaagataaatgctgtgtttatttggtgtaactttcttaattaacatttgtgcatgtagtttctcccttcactcttttgtttgtttctttatttgctttattgtgggtttaaaagtttaaaattcattgtttctgtctatttatttatttatttatttatttattttttgagacagagtttcgctctttttgcccaggctgacgtgcaatggcgccatctcggctcactgcaacctctgtctcccaggttcaagcaattctcctgactcagcctcccaagaagctggggttacaggagcacaccaccatgcccatctaagtttgaatttttggtagagagggggtttcaccatgttggccaggctggtcttgaactccggacctcaggtgatccacccaccttggcctaccaaaatgctgagattacagttgtgagccaccacgcccagcctctgtctttgctttttacttttatggtagctacaaagacaataaatattttattgttctccctttttctctctcttctcccttcactctctctccatccagtgccaagagcctcatagatatttagcactgagttaaatatattcactgtacttctttgcagcaaaatcacacaacatatacacttgtgaatttcatttcaaaatatgagtttctaacattagtccgaggtgctttttcatatctccgttgagactggatatatacatgagttgggctaagcaacaaagtgctggtccaggtttgaagcttggcaatataaaagacaaacataaaatgcatagagaatggacacatatctttgattcccagatctttatagggagctacagagtttggtgttcaacagtaaggaatatgctaggtcaggcgagtaaaggaaacacaaggacggttgccttttaagctgctgtgcagggctggagctgcataagcactctagggactgctctctgccgtctaaaaccttcctgtgtctcaagcaccagtttcccggttttatactgagtattctgatgtagagcattccaaggcatgatgtaccatggaaatgatgaagcttaaacataaataaaagtccagagatttttttttttatgtagtagttcagataacataggttatagaaaggcttgcagatatagggatgtgaggaggcacaggtaaaaaaggcacaggctgacattcatgccattattatcacaggaagtaagtaaagagaggagcatcttccaatactgcatgctattagtgctgttaaaatctgctttctcagaattcatacttcagtgaatttttaaatttgttcataaatttgcatatgatgctacaatttctgatttaaaaaaaatctgcctgactggttgatcaggaatttatctggaaggcaaaattttataggacactttttgggatatctgttgatttaagggaaaataaagtctttggtgacctaagttataaagttacacttcataaatttatgtctcttttctactgtctgttgcttagtttctacatgtgtgttgggtttgatcttggtaactctacttatggcccccattcccaacacacacacatacatacctgtacacacacatacttgcacatacgttcacacatgcataggtatgatttaagtctacagattgctagacacagaagggacagcaatcaagggaataacaggattgcagcaaaaaaaaaaaagatgtaataaaaatgaacatgaaaattttgagttaccaaggttaaaactaagtggatgaaaattcacaagcagaaaggtgaaacccaagattccttttcttaatctttctggaccaaatgaaactgctcgtatcatgtcctataggctctttatcatgcctttcattttagcaataatttattcatgagtctaagagacttttttgcatcatttaaatgtatcatatcttgacagttttttcctctcttcaggctcatcctactccattgtaatttatttaagtattttagtgttttagaggattgtggataatgatgcatttaaactgctttagaatgaccttaggctaggtaaattactgaagtagtgccggccagggatatttactttcatggcagtaagcttttactctcttgtttaaccacatggcacacaaagtcaccggctcgctggcttaaaatatattctgaaagagttacaaacaaattttattaacagggaaataactgttataatcttggccctactatagccaatatttaattttacttttcatgaagattgagtgactttatcttgactgttaacagtacaggtttgaaaagcagtgtgtcttagaatagtgctggccttaggcctgggcccatagttgaggtctcagcatctcacagtcatacatgcggaaataaacatattaaagaaaccgtgggcacttgtgttactcggaatcccacatttggagctggcatgctgtgacccttagcactaaacatcagctctgtgcctctctccacacaggccttaagaaaagcttcctcacccgtgatggcccccatcattcttacaaaagccaatgatctgaatgggcacattttgtgatttgtgctgctaacttttgcaatagatactgcttaggagtgtgggtagcctttggagtagaacagtactccagggagagaaaagacaaattaattaactcatcatattattttctctcatagtgcacaaatgcaatagagtttcgtgtaacaatatataactttccagggctccaagccaagcatccttctcttgtttcttatcatgttgcaacatatgtcctaaaatctagatttttctgaaccatcttaattcctcttttttcttaacttttcctcctggccccattctcccccattggaaaattggacatgcttatgtagaaaattctaaaagcttaattactgagaagtagctattgttatctctcaaaagaagatgcatgcaccctttctgcttatgatcacatcagcccacatcatgtttcagtggaaaatgcttgaaattttgtggattctgtttctagaacctccggtacttgtaccaagggtggctgtgaacaaaaccttttagaagattctttccctgctggatctggatctttgaaagcagtttcttttcaggctgactttcctactgtgttatctttccacttcaaatacttatttcaataggctgaacatgtaataaaggttaaaaataatgtagcatatgattatcaggatgaagaattgaaaggagatattaattaatggtggataaagtgaaaaaagaaaacataaatgaaattaccaaagtaaacattcagtgcaatttgatcactgcaaatattatattgaacaactaatatttaatctatgtattggtgaaataccagtaatagaaaacaatatgttagagttaataaacactttcattgttttacaaaaacaaatatagcttaagtgaatattttagtttaagtgaattacttgaaaaacataaacaacaaaaataaccttctcaattttatgtattagtttaaaacatactaccattttatttttcttcataaaatcccaacattgaataatttgatagaagaagaacttaagaaatactaatgaaactagctattcctttaggaggaaatagaaatcatgatataagcagtagtaattttgtaaaaatagtagtatttgatgaaaaactaattatttaaatcaaaatggttaaaatagtatgtaaaatggttaattccagaaaaaaaccttctatgcaaattttattactaataccaggtgctacatcacagcagagtttttttaattgaaaaaataaaactaagtatagcaatgtcctcccaaaactgagatttggcattactgtcaatataaataaaattattttaaaatctggattattacaagattataagtgattcttctaaaataaggcatgaaaataatttcatgaaagtatgtatatttcatgaattatgtttcttttttattatttatgcaaacatcactggcctatcagcagaatacctagatatgtgcaatagtaattgaattttgtctttggaaagacaaataatcttttcacgtacctttcggttttgtcattatgaagttccacatgtcaagagaacagaatagaatatatcttacttacatttgttatttatatagtatacattctaaatatttacaattatagtgtgttgatctttatttacacttttgaatgaagccccacaaatattaagggttggcctgtccttaaaatttttagttgttacatttcttatccttgcttactttttattttctgaaatgcaatccccaaagatgcaattatacacttttaatatttctctggccctcaaagtagacacaaaaaataaagttttggaaataatcctgtctccatgcttggtgtttttgcctgttcttgtgtcactatgaagaaatacctgaggctgggtaatttataaagaaaagaggtttaattggctcatggttctgcaggctgtacagggagcatggtgctgtcatccacttctggtgaggcctcaggaagcttacagtcatggtggaagagaatagagaatcgacatgtcatatggtgagaaaggaggcaagagagagagaaggaggaggtcctagactcttaaacaaccagatccccagtgaactaactgagtgagaactcacttagcaccaagggaatggtactaagccatttataaggaatccacccccatgattcaatcacctcccaccaggccccacctccaacactggaaatcacatctcaacatgagatttggagggcacaaacatccaaacggtatcacttggtggtaccacttattttcactttcaatttattttccactcaaattcatgccacaaacatcttaaaaggccttagttgttgcctgttcaaccatccattcaatatatctgcaattatatttccaattttacaagactgtcatcattgattggtaacaacatcctagttagatcgtgcactttttagaccatttttctttcttctatgaaattagttttattaaaacagaggagggctggtgaggtgactgctagaatgatggaataataaagaaatcttctattagtttagttttaatggttttttatgctaaatttcttggtagctcatatagaggcatcgtagcaggacacactttatgatactacaatgaatattctgtttaaaagatcatttatgtccctaaagtaaaatacaccacaaacataaaaaaatgactatgaagacaattcacataaaaataatgcacaaacgagaagatctacagagcaaggagggacataccttcttgcaatactctgttattgatatggtgacaatgccaagattgttcatccataaaagattactgacattcttgctgctaaccttaacaatggaacaatacagtaactggagacaaatgccaaaaaaaaaacaatttattcttgtttatttagattctacctatttttctacttcttttatatttcaccaaactcttagaattttgtgcttttaaccgcaaatgggcaaactttgcatttactttggtattaagccaggcagtgaggataggctctccccatattgtgtgtgcatgcatatgtatgtgtaatatatttggtgctggtagagaatgaagattttggatgaagatgttggatgaatttactgccaaaaaaaattccaagcaaacaaaaatctacatagttttagacattcacagaacatgctataaataaagatgtctggtggttaacagaatttttctttattatttgacaatcaatagtgtaattagtgctgattttctattaatgattaaagtaagagtagtcaatattgaagcaaaaattgtatatctgtaagaactggagaacaaaactcctttctataaatttctgctagaatttgatattgaagattactaacttcaaaatatctgtaacaagaaacaagttttgtgtttgtgtaaatgctcttctactagcatgcatattatgattgtgttgtgaaatgagacaatgcaattgcaggtgttaaaaagataaggtaactttttgttcattaatatttcttaatgttacctattaaattctaaaggtggaatatcaatcttttttcttctagtttgtttgctgatttcagtggctggggccagtccttgatttggaggatgaaactcagggtcattattatgttttttaaaaagtttcctttaccttcatcttcatcctatggttaactttgctaccattttaccatttatatctaaggtgtattttttttctagataagtgagatgcccatcattgtcactttcgtgttcactgatagaggcaccatcattattttcttgggaaaccctggtagttttgatgtctgccaaatttctgtgtagattgtaaaactcttggtgacattcaatctcatcttcctttttaaattgtgcatttttgttttaagttttattttcagatgtgaggtttggaagagctttagatgaagtaggctaatattatcagacagttcgttgatgtgacagattacgaaggtggaacagcagatatgaccagagcacttttcacttgtgggtgctggatacggagctgtgacaatgtaaaactggagaaagcacttgatttctgtttaggaaaaatgattccccaagaacaaatataacattgagaattgcacttggggtaataggaagcatataaattaatggcaccaggaggggcgctttgtaaagataacaagcaatttagtcagagatggttgctgtggcagggactttctttggagatgcttgtttccagctgattgagatctctgcggtctattgctttcttgctccatttcaaacaatcagcatgaaatagtgtagccagcctatctgcaggtttgctagtctccaacctgtagacattaatcttctgttctccattccatgaataatacttaatgaccttcaatatccaaatgttgaaattacttactgacacacttattcagtcactaactggtttgtgtactaatgaattcatttgccaagcaatagttagtaaatgaaatggtggtattttaataaccttgcaattctgttcaaagctgatacttcttaactgttttgatttttccattcaaaattatcccgtttgattggataattgcatctggaggacaaaattcttgctggtctctttgttctgagcgaaaatctgacagagacaaactaataacttctagatcaaagttgaccgtaggaatatgagttctggaccgaaagaaaaacttgaaatgatgtggagactatttatctattggtttatattaggtaatattgtcatgtcagtgttaatatcaatgtaaaattccagatatatgcttccttttctatattactgtgggaatataggaagtggctgctctgactaggatttcatagtctaactcccttggatgtaaatgtggtcctaagtcttgttcttactaatggaacgtgagcataagtcatatatctcattctcagctaacaatttagaaagtagatgtgctctctacaaccgatttttcccttcagccagtgggatacaaagaaccagaagaccctaagggatggtaaagacacaagatggaaggagaccaagtctccaaattactgcaagaaggaattccacctatcaagcaagacagctgctttgaaatgttatgttaataaggaaaaaaaatcacttgtattcattaaaccactagcatttgaggtttctttgtgacaacagttcttaataattaatacaggcagagtgttccattatgtaattcatgtccaataaattgtgaacatactcatcatcacagctactcaatggtagataaaattttcttatataatatttctacgggagtttacatggtcattcactgtaaattaggtttcagtatactttgagtttgctttatttcacttttcaaatcagggatagataactgtcatattgcctttcccatttattttatgacagatatgaggttctaaaattttaaaaatttttattcatttgtgagtaattttctgatatttcccatcatgtcagtatagtttgactgctgatattgtagttgatccactttatttgcaaattccaaattagcaaattcacctactcactgtaatttatttaaaatcctaaaaccagtatctggagggctttcatagtgacttgcagacagtgcaaagtagaagaaaatttgaatcacctgatgcacctgttccccatgtaaggcagaacaagggaactatttcttatcttctccttacatacaatcatggccataccatggccttacctacaaccatggccagaggaggtagacagtagggggcagtgcagtgtagggcaagaagctcctgcgctggggctcgttggctgcattttgaatttcaattgtagcatctgttggtggagtggcctcagttaagtcacttaacacttcatttatttactcttgtgtaaatttatttactcttgtgacataaagaaaataaaatctaccaatactagatgtatttaggatttaagattgtaatctattatctatctatgtctattcatatctttatatctattcatctctatatatggacatatatagatttttatatatttatagatatatatggatatgtatattcacatgtctctctagatatatctatagatatatagaaagctatataatgatatatgtccctgtagatgtatctatctatagatacataaatatatttatatataatatataattatatgtatttatattatatacacataattatatgtaattatatatacatataattatatgtaattatatatacatataattatatgtaattatatatgaatatagttatatgtaattatacatatacatataattatatagatatctatatctctctctttctctctgtgtgtatatatagatatatatttcccctacgagcaatggtcagtattgctaattcagcatttacagaaactttgtagaacacaccttctgtgagtaatgagaatcgactgtacaagtgtatcttggagatattgcagatttggttccagaagactacaataaagtgaatatcacaataaagtgactcacacatatttttgagtttcccagtgcatatgaaagttgtgtttacactatactatagtctattaagtatacaatagcattatacctgaaaacacaatatacacaccttaatcaaaaatgtttacgagcctccagtggttttaatcattttgctggtagagagacttgcctcgatgttgatggatgctatcagggtagtagttgctgatgatgattggggtggctgtgtcaatttcttagaataagacaacaatgaaatttgctgcattgattttgatggacttgtcctttcacacaagatttttcttgtagcatgtgattctgtttgatatccttttatccacagtaaaacttctttcaaagaggggttaattttctcaaaccccgacactgctttatcaactaagtttatgtaataatctaaatcctttgctgatatttcaacaatgttcacacccttaccaggagtagattctatatcaaaagaaacactctctctctgctcaactcctcatcccttcacgttttatcatgagattgcaccaactcagtcacatcttcaagctccacttctaattctagttctcttactatttccatgacaaatgtagtcacctcctcccctgaagtcttgaactcctcaaagtcatccatgagcattggaatcaatttcctccaaactcctattaatatgacattaccttctcccatgaatcacaaacgttcttgatgacatctagaatggtgaatcctttctggaagctcttcaatttacatgactcagatccatcagaggagtcactgtctatggcagcaacagccttttgaaatgtgtttcttaaataataaaacttgaaaatcaaaattacttcttgatccagggactgcagaatagatgttgcactggcagccatgaaaacaacattaatctccttgtacatcttaatcagagctcttgggtgaccaggtgcattgtcagtgagcagtaatattttgaaaggaattttattttctgagaattttattttctcatcagtaggcttaaatattcagtaaattatgctatagacagatgttctgtcatccaggctttgttgttccatttatagggcacagtcagagtagattcagtgtaattcttaagggctctaggaatttcagaatggtaaggtttagcattggcttcaacttaaagtcaccagctgcattcacctgtaacaagagagtcagcttgtgctttgaaatttgaaaaccaggccttgacttttcctctctatctatgatattttttccctatataaggctgttttgtctatcttgaaaatctgttgtttggtgcaggtaccttcatccatggccttagctagatcttctagataacttgctgcagcttctacatcagcgtctactgcttcaccttgcatttttgttttatatggatggtttctttctttaaacctcatgaaccaacctctcctggcttccaacttttcttccacaatttcctcacatctcttgtccttcatagcattgtagagagctaaggccttgctctgaattaggctttcacttaaggaaatgtgactttgtttgatctatccaaagcactaaaactttctccgtatcagcaataagacttctttgcttttttaccatttgtgtttttactggagtagcactttttaatttgtgtcaagaacttttcccttttttttttaatttgaataaatgtaagaggtacaagtgtagtttttttacatggacatattgcctagtggtgagtctgggcttttactgtgaccatcgcctgaatagtgtacattgtgaagaacttttcctttgcattcacaacttggccaactggcacaagagacccagcttggggcctgtggtggctttcagcatgccttctttattaagcttaatcatttttagcttttgatttaagctgaaagacatgctattcttcctttcgcttcaacacttagaagccgttgcagggttctaaactggcctaatttcaatattgtgtctcagacaatagagaggcctgaggagagggaacagatgggaaactcaggttgttgcagcagtcagaacactcgccatttatgtattaagtttatgcctcttactatcttccttgagatcactcccttaataataataggaagtgctttgtgtaattttcatggagcttgagaggagagatactagggaatgatttcttcttttttcatggacagtataaatgttttgtttgcacagcatttcaatttcactttcaactactttaagtcatctacatttgaaaatagaaataaagaaaatcttgtaagcaattattaagaaaattataaatatgataaaatatgattttacctattaatgtaagtctaaataggtaaatttacattgagaaattaaaaataataatttatttatctgtatacctattattaactgaaaatttacaagatataggaatttggaaaagatacttttattttttctcgtaaaggaagaaggtggccatgccgcaggctgggaagcatagcctctggcaaagaccagaaaaggcacttcaaaggaggaggggttggggcaggagctttatgctaaacaggttggctaaccatacaaatttaactggttatgagacaagctatgaatattaatgaaggcagttctgacacatgctcattgaataaatgtgcatgttgcatatgaactagtggagagttaacattttttggtttttgtttgagacagagtctcactgccatgcccaggctggagtgcaatggtgcaatctcggctcactgcaacctctgcttcccggtttcaagcgattctcttgcttcagcttcctgagtagctggaattacaggcgcgtgccaacacactgggctaatttttgtatttgtatttttagtagagaccaggtttcaccatgctggccaggctgttctcgaattcctgacctcaagtgatctgcccaccccagcctcccaaggtgctgggattaaaaatttaacatttaaatgtattacagttgggccctatgcatcaaaacgtaaagtagggacgtgaagttactccagtgcacagcctctgtaaactggccagaaccagtccatggtcagcgatcttaggaggagaaagttactgaaatcagtctcttattcaatcaaagctgttgttatggcttgtggaacaggggctggagcgcagttaatcagcatctggtgggactgtaaattgttttaatattgcttatctcgaagccagtgcttgtttaactgctaaataaaaaggaaaaccttgtggtaactagaacctagttcattttgttaagtgcaggtgtgtgactttacccttgccagcatggccttaaaccctgtttataatttagcatttcattacgacaaagagtaggctatgttagtcttatgatctctgttttaatgtaaatgctggttagttgtgtctaaactccaaaacaaagagggtataatgaggcgtgtctgacttcctttcttattatggctaggcactcagtttttaaggtttttctggggttcccttggccaagagggggtctgttcagtctgctggggaacctaggattttagatttagtttacactactgaatgctacaaaccattccaggagctattactgggttagttttaaggttcttagccaccccaataattagaggatattatcctaaaacaatgcaattcaagggaatatttatatcgtagagctttaatttcacttttctgtttgtgagcagaactggcattttaataaaggctcagggcatttctcgtagtgtataattcacaagacaaaaattgaagtataagataggaacgaacttgaatgtaaaagtaagagcatttttatttattcactatttctctttgatcctcaaagtaataagtattttaaattatagaactaagttcatactctgctttacttttccatctcatattttaagctgtctacaaacttagctcatcactggattctggcttggaattgttgtcacttcttattgttttctcttttggtagaatcagtcaaaagaatatcatcccagtagaaagatgtgaccaattgctttaaaaaaattatattttgactgaatcaagaaagtagaaggttcatttaaactctgtagaagaaccctcatcagtctctccatattgcttttgacaatgcctgagagactgttatatattatgtttatttttagagtcaaccaatctcttttaacttagactgcaggatgaaaaaagcaataacactctcagatagctcttaggttactgtgagtgagctgaattatttctttctattagaagctgctgtcctattcttcacttcctacagatttctttagaattaacacagaaaaaaatgttatcttttttgggtctattgatgaacttaatcttttcattattgcatgtgaacttaagtcataataaagcaggctgactctgagttttattcatctttgtgtctgaaaggccattgcaattttatttttctaattaaattgatctagacaacagttcaacttcctcaaacataaatatttcaaaagagcttactgccacaagcatccccttcaaagttaaagatttagaatataaactcttgttgactgttctgcttttgaatgcattagaaaatgccttagggaataaaaggtaagcacagagtttcactcaaaagtatttgctttgtttttccaagtaaattcatgctgaaatgcaaaatcagagtctcatattgattacctttcagtgaccaggcaaaaaaatagtaaagaacatttcaaagtttagagtaggaatatatcagaaaatatctaaaggtactgtaattactgaaatacatacagactcaaacttcaattaacaagttagatttcacaggtggaaaacacctgcttttttttctgttgtccaattctgtgctccatttttatttgacttattttatcactgtgttctgctttctatttatgaacaattggctcttattcaaagcagctgatgcccttcttttgcatataagtggcaactattctgaagctgtgaccacaggaagaaaatgtgtggggtggtggtggccgtattcaggtgtgcattgcttaaagaaacttgaaaactatatatagatgttggaaataagaaaatgatgggatgcataaaaagatataaaataccatttgctattcaaaagcatttatcgctgtctaaatattagctttctttatatatatatatatagctttctttatatagctttctttatatttatttatataatgcacaaagttttagaaaagaggcactgtaaaaataggtaacaaattcaattctttgtacgatagcttcacaaattaagaaaacccatgtatcatgatttggggaattattgccacctgtcagtgatatgttaaagttgatatggatgttaattgaatgtggttagagaaaattatgggatgtatcatttacctattagcttatgaattccagagtcatattaagaaaaagataagtcaagtcacttccgggtaacttgcatggatgtaggagttttttgtttttgtttttgagatggagtcttgctctgtcgcccaggctggaatgcagtggcccgatctcggctcactgcaagctccgcctcctgggttcacgccgttcgcctgcctcagcctcccgagtagctgggactacaggcgccgccaccacgcccggctaattttttttttttttttttttttttgtatttttagtagagacggggtttcaccgtgttagccaggatggttttgatctcctgacctcgtgatccgcccgcttcagcctcccaaagtgctgggattacaggcgtgagccaccgcgcccagccagatgtaggaggttaaagggtactcttctctgtctctctgtcataccttttctttcaaaaatatcttattacttcccagagaataatttgaatggcaaaagtacttcattgatgaaaatacagaaacagttttatttaaaactcaggtgagcatttacctgctggtaagttttgcctcctcacaccttcctccccttctttccccttcttacactcagccttcaccttcctttcttttcctatcttttcttcctcctttactgccctttccttcttcccttcttttactatgtgttcattcttttcttttttttctgttctttcttacatttttttttgttttcttcttttccttttcctttatcttgcctttcatttttctctccctttatttttcccaagctttttgcttttttctctcttttgtttagccactctttttttttttttttttttttttttttttgagacagagtcttgctctgtcgcccaggttggagtgcagtggtgcgatcttggctcactgcaatctctgcctccctaggtccaagcgattctcctgcctcagcctcctgagtagctgggactacaggtgcccaccaccacgcccagctaatttttatatttttagtagagaaagggtttcaccatgttggccaggctggcctcgaactcctgacttcagttgatacacccacatcggcctccaaaagtgctgggattacaggcgtgagccaccgcgcctggcctatttagccactcttcatgtctctttctttcttttcatttttccctttcacatagaggccttacatgcagcactggaaataaactaagaaataagagttattgcctttaaaacaatgtccagtaaaatttcacagaaagctacaaataatgactattcattgtgaaatatatatacgcatatactcttgctgggttccctgagggcagatgttggatcttgctcatctctataacctccttacctgatgctgcctagcacagggaagcgggcagtgttcatgtccttcccagataccagtgtctggcctgctgcacccatcctttctccttgtgagtattgcctgcctcatattcaggaaagctgctcttggcccaatgctaatggctatgctctccaaataatggacttcccaggttgcctcaaggggatataagaatcaagtgtaggtacaaagttatgttttgaacatgagaaacggctgcaccagtttcagttgtcaatttccatgcatcaacattcacaaaattgaccccatgataggtatctgctatttgcttgtggactcctgccacagttgacttcctttgtacacaggtgttagatagaaagttgttgctatagaaagtaagtgagaggtacttggataacatcttagtccatttgggctgttataataaacatagcatggactagattacatataaacaactgaagtttattttctatttttctagaggctgggaggtggaaggtcaaggtgctagaggatttggtgactggtgaaggctggcttcctggttcccagaaggctatcttctcactgtgttcttacatggtggagggaacaaagaggctctctggaatctcttttataagggatttaatcccattcatggactaattacctctcaaaggccccacctttaaataccatcacattgaggattaggtttcaaaatatgaattttgcagacataccctttccatccatagcagatgtctgcgtttctatgggatcagacataagctatgctctagctgagacgacatcctggctttattctgcccccacctcctcctgctcccctcacttttttccttgagagcactcccttaataagttacatgcaccccctttcccttattattagcatcttgcattagtgttgtggatgtgttataattaattagccagttttgatgttattattaactaatgtgcatagatttcattagagtttactctttgtgttgtagaatctatgggttttggaagatatataatggcacatattcacccgtaccgtatcatacagaacactttcactgacctaaaaatctcctgcactccaccattgatctctcactcccttcccccaagccccagggaaccacggatctatttactgtctctatagttttaccttttccaaaatgtcagatagttgaaattattagagaatgcagccttttcagattggtttctttcacgtagcaatatgcatttaagtttcctccatgtcttttgtggcttgataactcatttctttttgttgctcaataatattccattgtatggatgtagtacagtttttatgtattcacctattgaaggacatcttggttaatttcagatttgggaaattataataaatgctgtaaatattcttgcacagatttttgtatatatgtaagtttttaacttgagtaaatatcaaggaacataattatgattttatggtaagagaatgtgtagatttgtaagaaacggccaaactatctttcaaaatggctgtggctttttgccaccaggaatgactgggagttcctgttactccacatcctcactggcatttggtgtttgtcagtgttttgggttttagccaatttaataggtaggtagctatatctcattcttgttttaatttagaattatctaatgacatatgaagttgagcatcttgtcacataaattttgcatcggcaaatgttctttgattaggaatctgttcagatattttgctcattttaaaattgaattttcttattgttgagttttaagagttctttatatattttgaataataattctttattaggtatatattttgcaaataatttttcccaattgtgtcttatttttcattccctaaagaatatatttcacagaacagatttgttgttgttgttgtagttgttgttgttttgagacggagtcttgctctatcacccaggctggagtgcagtggcgagatcttggctcacggaaacctccaccttctgggttcaagtgattcttccatctcagcctcctgaatagctggggttacaggtgcccaccaccacacccggctactttttgtattttttttttttttttaattagagacggggttttgccatgttggccaggttggtcttgaactcctgacctcagggcatccacccaccttggcctcccaaagtgctgaggttacacatgtgagccaccccaccctgctgagacattttaattttaataatgtccatttaatcaattttttatgaatcatatatttggtgtcgtatctaaaaaatcaccaccaaactctggctcacctagattctctcctataggaggtttatggttttgaatattatatttaggcctgtgatctattttgagttaatttttgtgaaaagtattaatgtaaggtctgtctcaagtatttttttcgtttgctttcttttgcatatggatgtgcagtgtgagagcaccatttattgaaaagcttattctttattcattgaattctctttgtccctttgtcaaagatcagttggttatatttgtgtgggtatattccttggctttttatttcattctattgattgatttgtatagaataatctattgtcaatgcaattgtcttaattattgtagatttatagtaaatcttgaagtaggttagtagtatcagccctacaacttgtttttctccttcaatattgtcatattctttcttcaataaatacttattgagtacttgtatttactcttctatgagaaatagcagtgattgtgacagacaacagttctgcattcatgaaatttatcatctagtggggtttattagttctacatgcacacattgacttttagtatttaataaatacaagcatgaaaataagtagaggtacattgcatattataaatctcctggttgaatgttagtgtatagtaacatattcatgtacatgtaagcatgtgtacatgaaagtgaaataaactaagtgccttgattttttaaaatgaactctaatgatattttctataatcttgtctccccttgctttctcagtattttatttaaaaaaaaagaagtatattgaaccaaattcctctgtggaatattaccccgaaaaatgctcagtgaacaatgcactattagaagggatttttatagagcaaatagtaggaaagttgtacacaggaatgcagggtaagaaaaaatgtttcagatgtggtggtgatggctttaacatagagaatcttggcttgaagttccaggaaagccataaggagtgggctgataaggttcaacagtaagcagataaccatttcagtgattttaaagtctaactagagaaagctagtgttgggcatggttaatccttggagagtctggaacatagttgattcatcaaaatgagagaaaaattaaatgattaatgatgtgataatagcgatgaggctaaaaagaacattttttgtaaggttatagaagtattatggcaagaattggtaagcctgttcttttgcaagttgatgataaggcaatattactctgttggtaatctaaggttacagtaaattgcacatgagctgctttgcagggctatttttaatttgggatgaagcaagagaaatgccctaatgcatatgtttttgcaagggaataaggacatgggaaactctattatactgagtcatagcagaatttagtgaaccacatctgtgtcttgcctggttcatagctcaggctaatgttttaacctgctcaataataatcactgaaagacatcggtgcttagatcaatgatatggttagtggaaagtgtgtaacaaccatatttatggcatttccatttcctcattcaattaattaattagagatacttgggattttgtttttgttttgtttttaatgtttcatttctaggcatagaaagcaatatagaaattatgtataaagtgttatttatgctctccaaattctgcattgcaaaaagttaggtaaacttaggaattagatggacttatttgtatgatcattttaaggtatagacagttatcttcactgaaataataaaaacatattatcatgttattaatcgtgtgttttgttatcatatagtgttaattctaggaaccactaacaaaggagttttgagtcatttttctattaacagattaatttttttgaagtaaaaatttccagaaatactaggatctctcagcaaggggaagaaatgggcaaacaaaatgactaggttcttattacataaattatttgattaattcagcttagcaaccctatcagatatatgttaatatccacacttttcaggtgtggaatctgaagcctatagatttttttttaattgctcaagtactcatgccaagtaagtaaaaaccaacattatgcaatacaatttgatggctaaaaagtacccatatatttacatacaaattaaactttttacatgtacttctttcacacaccacaaatacaaatgtatcttctttttcaggtttcttaaatcaggaacttgcagttctcttcaaaagcataaaaggaatgcttacaggttcaaaatattgactgaagctaacgttttcaaattattagttacatgcatacaactataaagctcaggaaaaactccttatatttcttttatacaactataaaattaataagatatatgttagtactaaataagatagcaatactagtcaaactttttaataagcccttaatgttaagaataacattaatttttgcagaaatgatattttgtttataatgtgcaatataccggcttctcatatgtaagctttaaaaaatttttccatgtaaatgctaatgtgtctcttcataattcagttctactcaggaactttaattttgagaatacctctcaatgtcaaatgatcttcaacacaggtgtatctttctgtgttccactcatcttttcttataattctctaggattacaagagtactcatcagcttcaaagatggtagcataaatgaaagcacaagagctaatgctctgggccatattcgattatacagtggttatccaggcagttcataatatgcttattgtgttatttatattttaatctaaatgaaatagagcattttaaaattttttgaactcccaatgatatatttttaggctcccagaattcctaagaacaatcttcactcatccatgactaacctgaggtgtcatgaataatgtccccttgagtcccttcaggaagggagggagcatggtgtgtgtggactccccaagattacccttagtcttgatgacacactgcaaggatgcatggaactgagaaaaaaatcggttatactcatggttatagtttattatgacaaaaggatacaggttaatattaacaaagaaaaagacaaaattagaagaaaccagatgtaagcttctaggcagagatagtagagttgcaaaaggacccacgtagttctcccagcaatgttatgtgacagcacatgctaagtgtcatcaatcagtaaagcttacctgagctttggtgtccagggtttatgtttgaggtcagataagcatgtagtgactgcatgactgacttcagctcctcagactgcagccctgccctgcctcccactcaatctctactcccaggaaaaatagacattcaacataggtcacatggttaaggtaaacttatctggtcagattgatacaatatggcctgaggcctcggacatatagaaacactcttttcaggaattatattcccagggctctgaggttatctccaaggagctggccaaaattcagtcctgaagacagacctttctttggaatgttcaggatttgagtaattcagacctactgagttaaccttttactgtccacataagaacaccattatttgattaaataatccataataatgtttgtcaccacatatttagcttatagaatgtgtcaagccctgttcaaacattaccttaggtttttttctcaacaaatacaatattaaatccatttgctgatgaggaacataaaatcagaaaactaaatttcccacaccacatggctagtaaatattaaagctggtatttgaacaaagttctatttgattttatagtcttgctctactccctctaccatatacattgcagaaatttggaccttcatagtctataggagaaatatccagtaaaataataggacctagagtcaatgaatgcaatatatattgtcatggctttgcttaagcaccctgacaacctggctttaatcctcactcctctagattgctcattgtggaacaatcagtataccaactagaaaataaccaccagaaaaaagactctactttataatcctttagccctttcactgaatctgcttcttcacatgtttaacatttttaatggaagctggacattggaaatgacagattttgaggagcattgattatattgtcttccttaacagggtgttgattttatttgaccaatcagtaaattactggtagatactgttcttcctctgaggatgcatttcttaatatggatctgtttcggttctgttccttgtcctggaatgcagcccttaatacagaatatagtcatttttgccttaaagtgtggcttttctgacattacaagtgagtgtcttaggtgcccagtaagatttctcccatctgctgggtgataacgccaattccaaagtcttccagaatagaacaacctctgatacctcctccattcagcattcagcttgtagccataattctccattaggcctctcacagtatcactctgtacctgttcagttcatttctcagccaaagaccccatgaagatttatgaccaacatatctcctgtccaatatcgtattgtacaaattccacccatttctgcaaattaaaactgcagtctaagcctcctcagctctgcaatattgagcatagctccatgtctcattcactgaaaggcgccccagataggaagccagtatgaagagagagtttacctcctgagtgttcctttcctcaaggatcacagtgtgtgctacttctggttcaatgctttaaaattatacccatataattaatctagtttaatagtcatttactacaggaaggccagtccagttaacagttattctgtcagtgttgaagtcactaccagtatgataatcaaataaaatagtttaattgacatttgtaaccctttacaatttaacaccagcttgcttttcctgacctgtctcctctattcacatcagttgagtatgtttttcacttctcaaacacttttgaaactcagtgcatttaagcatatccttcttttttcttgggatgtgttttcctctcttccatcaatcttcctcagtttttaagacccaggaaaacttaccgcttcccctctgaagttgttcccagccactcccactaagtctaaaatcctgtgccacttacctatattattatttatatcatccacagaactttacaactttcataggtatttctgtgtaaatctatcttccaaaataattttgagatatttataaaaacaaatatcatttgtttgtgtagagcaggtattcagaatttaaaaaacatatctgatggtattttttgacagtatgttttacaaaatcgcttatattattaatgtctgatgctattacttaaccactaccactatatgtagtgaccactggccactaatagtgtttactatgatcaattttattaaaggctttgctttaattatttaattatttcacttattctttccaatggtcttatatggaaggtggtatttcttccatactaaagttgagaaatactaggtagacacgaggtaaagaaacttgtggacaataatttagcaagcttgggataaccagtatttcaacctagatttttccattgcaattcacaagttctatactatggcaatttatgtaacaggcagaggtcttcagaaataaattagaattttatttgagagataatttttgaaatgtcacattccattattagcatattcatatgtagaattattgaagaagataatatgaatgaaagtaatttgtctttggtagtagtttttcattctttagggaaaagcattaccaggccattgatttgagatgagactgcagaaacttagaaaaataaaacctcagtgtgaactgagcatctgtttaatcatgtattaatgaaatttatttaaagtctgaaatattctaaatacatgttaatttatttaaattctgaatatataaaactgtttttgagaatttggaaaatatattgtaattatcatattttagaaagtaagcaagcaaatactagcatcttacttaaggagaaatgagatgaatagactagaccaaggctttttttaaacgtaaatgacttatggtattgaaattatgccttattagaaagtcgactgcattttataaagaatgtcatattttatgtaataatgtaattttaaatatcttgactttagtaagactgaatattttcctttgtaaatatttgcttaaattatattttgttagtggtatagagtcaactgatcaaatataataacctaaaaagtcttaagtgtatgaatgtcatttattttattagcccccaaattatctgagtttttctcaggacctatataattagattttgaattagaatgtattgattataagtgaatacttcaaagtgattgatattttcaaaatgcatattgtgaagaccaaaatatatttgacaatagagatatggagtaatgtgtcatctgaagaaacagaaattttaccttacaaactcttatttcaaagaattttgtatgtaggaaagttaggtatctaattcactgaaaactaactagcattggcttacaggattgaattgaaggcagacatgaagttgcgtgaaataccagtcattcaggaagtgaatgaaataccatccttgaaaggagtacaaggccctagaattaaaaatggtgataaatatggaggattctcttttatttcacttgactgaagaaactaatcaataaacatattttttatgatcaatgtcaattgcctttttgggatctattgtagacctctgtgtttaactaatataactatatggttttctattatttcatatggagagactagaagagtggtgtttttgtaaataaaagaaatagaatttctgaaagaagctaacttcaattcatgtatttttggtaattgctaccctgttttctttaaaatagctaagacattctggctctagttttttgccttcagactttttgatctgttctcattacattcttggtgatctatttcatctttctgtaattcagtagctaagtaatatgttacaatagttgttctaaagtttctgtaaaggctttactagattattaaagttaacactgagctggatattcatcattagtcaagaaaaaaattataagtcctccagagtgaaaactcctagtaggacaaagtgcatgcattaaataatgataatacctgaggagaaaaggaacactttttttttttttgagacatagttttactcttgtcgcccaagctgcagtgaaatggcacaatggcagctcactgcaacctccgcctcccaggttcaagcgattctcctgcctcagcccccaaagtagttggggttacaggtgcccgccaccatgcccagctaattttttttttgtatttttgtagagatggggtttcaccatgttggccaggctggtctcgacctcctgccctcaggtgatccacctgcctcggcctcccaaagtgctgggattacaggcgtgagccatggcacccagaaggaatacttttaataccacttctaaagtatgtcactgaaatatctttcatagtttgttttgttgattatttgtgaaaatataaaattttgtaagtactttaacattctcactcttgtaatcctacttaatatcttatctttaaaggaaataattatctatagaataacttctatgtttataacacagatttaggttctgaatatgattaaattgggagaaacagtggctcgaatataaaaggtcacgattatctttaaggaaaagaaattaagaaaatgaaagacaactcagtctatgataaatatgctcacatatgaggtatagtgattaaattcttcaggaactgaaagaaattagatagcaagatatgctagcatagtcagaaattttatttcagggtacatacagattaaacaagaaggtatgtctatagtgtaacaaaataacattggaagctgtaaattgcccactgaatctttcctgatagtcataccacacagaacccaaattaaacctagtttactttggatacctaggttataacataattaggttcatattagtcctaataaagctaggttttggcttcatttttaagagatgcaatatttaataacacttcccccacagtccaccttctagtttcttacctgcaaggtactgaaggcacttgtgccacttcctcctgctagagattgaaaaatccactaactctgccttaatgagaaagaccaatcttgtccaaacaaaatttgaaatacttaaagataattatgctgaaaaaaatattttaaaaatggagaaaatgggagccagtgaaaagagccataagagaaaagatgggaaacagcacttaagaggtacatataagcattatttgatttgacccgcctgaccagcatgaagtaaccccatctctactaaaaatacaaaattagccgggcatggtggtgtgcacctctaatcccagctactcagaagactgaggcagtagaatctcttgaccccgggaggcggagattgccgtgaaccgagatcacgccattgcactccagcctgggcgacaaaagtgaaactctgtctcaaaaaaaaaaaagatttaatcttggaaacctagaaaaaatgttaagggactgctggcttattcccttgataaatttcaagaaacctggtttctatgagtcaagaaatgaattgtgaaatataatgagagacagacatacaaatgggtgctggctgaaaggtgagcagaaatacagatagggtgagatgagaaagcaacacagaaaaacagtaatggtatgtgagacaggcttatgagaaggtcttcgattgtagaggaactaatagaaaaactgaattgatcaggaagaaaaatataaatttcaaaattacaaaatgatgatatccatcagtaattagttccagaaagtcagaattaattaaaataggttgctaaatgatttttttagagctgtagaaatttaaggcaatcttacatccagatagtttagagaatgttttgtatttcaaggaaaaaagtttttctaaatgaaacaaagcagaaatggaaggatccagttttcaacacataaatatggattgtgtctaacttaatctcttaaacattagatgccaaaagaaaatatgagcaatattctcaggcttttgatgagttatttgagaaggcaaaacttcaatatgcaaaattcaattgaaaagtgagtctaagaatgaatgcccttgctgaaatcagacattttcgtgattgttttctgtcaaataaaatctttttcatgattgcattctgtcaatacatttcatgattgtgttctgtcaaacttttacgtaacaaataagacacttaacaattcaacaattactagaagtaggtggaaggcctcccaaattattatgaagagttggcataattctctgttaaatataaaaaaggctgttttcccaaactcccactaaaaagagacttgttatcaatagaaaataaaggaccctaataatggaattgttatcaatagaaaatgaaggatcctaaattaaataataactaatagaatccagcactgagttaagaagaggagcaggtaatgttgtggtgttttaaaataaaaaaattggacaatatactgtattatataatgtctttcataaatcctctaaggtaattgatataattcaacatcaattaatcaattaaatgtttatttttctttaatttttaaattttttttcttaaatgccagacttacttttatatgatgatatcatttccaattagagtcaatattacagtgaaatattattgaagaaaaaatatatttaaaagctagttataatcattactatttaacattgacttggaatacaaaatgaaggggtaaaattatctcataggaaagtttcttttttctctctctctctttcaaatagtcgattgtatgactagaaaaccagaaaggctcatttgaaaatgatttgaaattatgagattataactgttttagtcagttcagcctgctgtaacaaagtaccatagaccagatgactgacaaacaacagaaatttatttctcacagttttggaggctggaaatctggatcagggtgccagcggggtcgggttctgttgaagacactcttgcacattgcagactgctgacttcagtctgttgtgtcctcacatggtggaaagagggtgagagcattccttgggttcttttttcataatggcattaatcccatttaggagggccattcttatggcctaattaactcccacaagccccatctccaaataccatcacattgggcatgaggatttcaacatgaattttagggagacacacacattcagtccattgtataattacaggtatttacaaaataagtataccaacataattagcatttttataaactaataattattatctactacatttaagaaaatattctattcaacctggtaaaatacttttataatatataaaatatgataagtttaggagaaaatatatagaccctagatgatgaaaactagaaaactctagagaaaatgaagtaaatacaaaataaactatggataaaatgaaagggataccattttgagaggcaacattttcctggatgggaacattcataatgtcaaatgttggttctccaacaatctaaaattgataaatctattaattcaatgtttcccaattcagttgacaaaagggccctaaaggtcatcttgtataataaatgtattaaaatagtccagaaatttctgcaaaaaaagaattagagcacactttcttatctggggaaacagaaccactattctcacaaatgtcagtcaaaaacctgggagtcaccagcgatttgtctttgctccttcacttccaatgtccttctagtcacattttccattctgcttacaaagtaactcaaatttaccacttgtttccatccccgacacctcaattctaaatcagaccactgttggctttcacttacatctgtgcacagctattcatcagtgtctctgcattaatatgtttccacacagtagccagtgatgttttgaaaaaatcaaatgtcatcatgtcacttccctgcttaaaattccatgtggatccaacagatgtcttcagatgcagtccacaatttttaatatgacttaagacagtgttggcattaaaatatattgatgaaattaataaaattctgtatgatcttggctctgcttacctctctaacagctcactactatgctcattcacaatttgctttattcatactaacattattcatttcctcaaaggtctttcatttcagggtcttcatttttgctcttcctgtacctttctttttctctttgtttaacctttgggtttaaatctagaaatctttaattttgaggtgctttttttttttttttgagacacagtgtcactctgttgcccaggctggagtgcagtggcatgatcatagtttactgcagcctcaaactcctggtctcgagcaatcctcctgcctcagcctcctgagtagctgggactgcaggtgtgtatcaccaagcctggctattttgttttttcttttagtagagaaagattctcactgtgttgcccaggctggtctcgaactactggcctcaagcaatcctcctgcctcaaccttccaaaatgctgagattacaagtgtgagctacctctgaagtgcttgctgaattctctgcatttcccattttaagctttcttcatgtttgtctgctccttaccctacgattttgattcgcgtctgtaaacaatagatatctcttttattctttcattccaaactcttgaaatcctaaacaacctgtggatgacggcaaagtcgtctcttctcttctcctgaccctgaatcatcccctctgaaataagtggctctggagtgaaagaagaaaatgcaggacttgacacaaatatccagcagcaaactttcttttctgcctcaggaaattatatttcacctaggacattttgctattgtttatcaaatattctacctcccttgaatcatcttggaacacaggattcttgaatcgagccttctcctcagtaactgaacattctttctttcttttttttttagacggagtcctgctctgtcacccaggctggagtgcagtggtgtgatcttggcccactgcaccctctgcctcccgggttcaagcgattctcctgcttcagcctcctgagtagccaggattacaggcgtgggcccccacctggctaagtttttgtatttttagtagagacagggtttcaccatgttggccaggctggtctcgaactcctgacctcaggtgatccaccctcctcggcctgccaaagtgctgggattacaggcatgagccaccgtgtcttgcctcaaaattcttttctcaactttcccagagagagagcattccgcctcttctagcttaacaacttcatgtaaacgggaagatataacagggtagtagaaaaatctcaggagaaatccaattacctcagttggtatagctaaaagatttcttcagacttcaagctatggggtcaggactatgtttttataattctcagaggaatgccttgtccctatcacagggccaggctctgttaagtaagtgataaacgtgtatagaaagaaagagaaaaggaaggaaagaatcatgtcatacaattagagaataaaacaggcttcttaaaattcaattgaggagctaaacaaaatgaataatcaatactctttaaatataataatttgatttatttcttacaaatgtctctaaggtgaattggacttcttttgcagcttttttgtctgcctcttcctcttgcttggcacacccctgcccatcttccaatattagcttaaatattaccaacctttttgtttttctcccagtattctggatgttttacccatatattatacctttcatacatcttaacaaatttttactgcattgcaattttaacatacctgctatcttgcctcccaaatacatagaagattattgagtccattgactcaagtttcatttatatttctgatatggtttggctgtgtcctcacccaaatctcatcttgaattgtagctcccataattcacatgtgttgcgggagggacccggtgggagataactgaatcatggaggcagtttctgccatattgttctcgtggtagtgaataagtcccccaagttcagacggttttatcagggtttccccttctgcttggctcattctctcttgcctgccatcttctgccatgattgtgaggcctccccagccacatggaactacgagtccattaaacctctttttctttataaattacctaatcttgggtatgtctttatcagcagcatgaaaacagactaatacatttttatcccaacaccttgcactatctggtgagggaacatatttaataagtatttgttgaatacagaaatatgttttatttacttcattttaatctgatatgacggagaccaagagatcatgcaggacgtattcgcttcttcttcactggaagatgagcgttttgtaaatagctgcattaccacctggactaagattatattctgcagttccctttacaatgagtatgattatgtggctaacttcaggttaatggtatatgcctggaagtttcatgaatgatgcccagaaagtatccttaagggagataatacatccttcttgaattccttctttctgtttgctggaatgcagatacgatagaacacaaagaggcctcttccagacgttgatgtggtagatcaaatgtacccatgcccttgatgacaaactgcatttatttacgtaggacaaacataagctcctatctagcttgaactactatggcttagggcgctttacctctcacaactaaaactaaatcttaaccattgatataaatatcaaaataatttctgttaagtgtattttttttttggtcattggtataggttgaattttgtccctcaggaattcatatgttgaattcctaaccctggtgcctcagaatgtgactttattggaagtaggatcattgtagatgtaattagttaggatgaggtcctattggagtaaggtgggtcactaatcaagtaagactggtgtccttataatagagaaatttgcagacagacacatactggaggggaggtctatgctgagattgcagttatgcagctataagccaaggatcttctagagcctaggagggaggcttggaacacatcttcttttacaccttcagaagcagcatgaccctgctgatacttcagtcatggatttcttgtgtttattgagatagtaaatttctgttgtttaagcctctcaaattgtggtaatctgttatagaagctctaataaatgagtacatccatttcttccctagtaatttaagatgaaggaagatcattacacaattaaaaataaaactaatttactttagcattattatattaatgtgtaataataaaatagtgaacaactacattaaaatatgtacaggtaaatacagtagtcccttcttatttgtggggagtatgtaatgatactcccaatgggtatgcctgaaaatgcacacagtacagaatcctatatttatcatgtttttcctatacatacctgcctagaataaagttcaatgtattaaaaaattacacatagtaacagactaacaattactactaatagaacaattaaaacagtatactattataaaagttatgtgaatgtgatctcagatattttctgtaacattttcagactgtagtcaactacaggtcactgcagaaagtgaagctgtggataaggggggactgttataatagaaacaatatagtcaatcttcaatcctcagtgcttcttttgaccattccccccaccccaactagaaaatgcctttcactcccttcgcccctcattaaccttcagcatgacattagttatattgcccgcatccttgtatggaattactaaataggaagaagttaagcaaaaatgtataatgaatgtaagaaagcaatggctctgtgcatactaccattaaaatagtgacacctatataaattatatttaggtcccgaaaaaaacactacaatgattctgtttctttaactcagatcactcaaatattatgttctaatggttattagatttgtcatctgttgtaacaattacattatacataaaatttaataacaacgtagtcaacatgagccttcaaaagagctctacaagttacctgttttcttattaagctaaaagagtagtagagagaaataaatgcagttatgaaagctgtgtgttataaataatccagtgttgcaccctccacaatgatgttgtccatgaactctgaatgtaaattgtagattactttgaaataactaggttagcaaaacagatttagttacaagccaggtgttttcttaagtatgtttagatgcttttttttttgcaactttgttagatatactttgctaaatatatttaaatgaatctttgcttttgtgcacagagcaaagctaatatgttgcttcatagtgtgttggagaaacattttttatttcttgccaaatgagatcattcatggcacacctgacaagactttttcttgaatcatgcctgaagccgtggctgaactatggcctaagccaggtagctgtatttatcacttaaatgtattgccttatattaaattgattttatatattatatacatatgttattctaaataatggcagtttttataaaatttctatgaaaatcgttcctaagaaaagtaatatttgaggtaagatgcctaaagttctatactcaataaagctctaattcaataaagaaagggacttcattcatctttttacaccttaaatatctaggctgccataacaaagtaacacaaactgagtgacttcagcaattcaaaatttattgtctcacagttctgaaggccacaagtctgaaatcaaggtgttggcagagccacactccctttggaggtgctagggaaagttctgttccaggcctctcttctagtttttggtagtttcttgtatttgcatattgttctccatctgtgtgtgtcagtctgtttccaaatttgcccctttttgtaagaacaccagtcatattgaattagggcccacctgaaagatttcattttaacttgaatacctttgtaaaggtcccatttccaaataaggtcacattctgaggtactggatgttaggactccaacatgtcatttttgggggacataattcaacccataacgctctctacatctggcaagatgattgacatggagcttacatccagtaaatgtctattaatagatacacaaatgaattatgggagggaagatgattgaattaaatttacacataaatcgtgaatcctgagatacttattactatcataggaacaagttatatgtgcatatgtgtgcgctcaaggccagcatttaatattggttacagcaaacagaaaaatttttaggccatgcaaggaaaaattcagggatacagccagttttgcttattttcctttgttctatattttaaacaaatgatcatctgttcttttcatcaccagaagaaacaacatattggaccttggcagaaccaatccattagagtaaatccaatgcattcattgatatttactatgttgtatttgttcaatataggatgattgaacgaacttgaatctactataagttcatttatcttttctacgccatatgtacaagttacagattttgtgaattaaatggagataagaataaaattgtgttttgagattttaatcctgcataatttgctttaaatcaagagaaaatttaggagtaaaagcagcagagggtatatttctgtatacccatcatgctcagaatcctgcctagtgtggaaggcaagggtgtaatttgatgagccttttcttgtgttgcctccttaaaggcagttctgaaaactgtatttcttcttggattgatttttagtgtctataaaaactttataatagtgatttatcaatacttctactctctttataagtaattatctcaattacctataaaaaagttatatatgggttctactcatatataacttgtattgtatctgatgtgttttgttaattctatggatcaataggtatatcaagatttcagactgtacttaactatacttttaccagtcttaggtaaggctatatagatagcctttggtaactgctgaatgtggagttgaaggagggacatgacattactattaggttattgaaatgtcaaaaatctttcaatttgagggaaagaaactgaaattaacatatgatcaggaagtcaggtgtttagccaggcttaggaaaacctggaaccaggtgttgaatgccggcagaattctctctttttattcatgtctttttaatcactgttttttagtttctgtctattaacttcctccttttgcactgatgacttgtgttcttcatgtgcacaaacatggttaataatagatttgacacaaaccttccacaattgttaccaaaaacaaatcaaggactgactctcattttttgttttttgtttgtttgtctgtttttgacacaaagtcattctgtcatccaggctggagggcagtggtgcaatcttggctcacggcaacctccgcctcccaggttcaagtgattctcctgagtagctgggattacaggcatgccccaccatgccaggctaatttttgtatttttagtcgagacagggtttcacaatgttggccaggctggtcttgaactcctgacctcaaatgacctgtccatctcggcctcctaaaatgctgggattacaggcatgagggactgcatctggcctcatgttctattttttaaatttcctagggaaaagtcattctagggaaaaattttcattggccagaattgggctatgtatttattcctgatcatcaaccatggctgggagatggggtcccgtaaaatcatggagacacctggtccagccatagggagttgtaggaacagacacttgcagcggaagtattgagtttttgtcctagaacgaaaggagctgagacctaaaatactgtgatttccacagaaacaaaccaacccaagaatctattttaaaaactttctcattctgtaagaagccttgtgctagatcctcaggaaataaaacattaaatatcacagaccctaacctcaaacaatgtacaaacttttgtgagaatggagtaagagaatggagcaagcataattatcaaacatctatagggcaacgaggacatttcctctctgttccttaaaatcaccctgcagaaatgtattcgtttagctgtattataggcaaaaacaaaacaaaacaaaaaacaacaacaacaaaaactatcaccatgaaatagctttacatagaacagtagatgggttcaaaggaatgagagaaatcacatttaagataaacaggaaagggttcacggggaaggtaatgtgagcctttagcgataggtactattttttgatgatgataatgttaccaggaagtgtgggggtccttggttcttgtcttcttggaggaaataattcagccaagagaccaactagtaaaagaagcaaagggcttattaaggaaataagagtagactccaagagaggaatggactgaccgggctgggagcagcccagaaagttctctgttgggtttttattctgctggactatttctttaagttcccacctctgtctccagtctcctcccttgtctttttctactttcctaattctgtcttaagtctttgccttgtccctgcctagttccctcccaggtctgtgggacttccccttactgtcagttgatgcacatgtgtgagcacaggtgatcaatacgaatcctacctaacagcagggcagtgttgctcattaccaccaccccaggaaggttgtatagtggttaaatctgtgcttattgttcttatgtatctcttagaattccattttgccccgtttcccttcttctcagcatgtagctagtgacattctgacattttaactgtggaatgggcaattactgggcaccataaggggcattttgggtgttgctttctgcataggaattttccctcctttctgctcatatctagtatgaatattttgggtggtctctggggcatgggattttccagagcttcctcccccaggtgctttatttcctgctcatggctaactatctgcctactctaacaataagattacagactaaaaccctggggttaaaaaccatgttgtatatttgggcaaaaatgaattatccaatagaggttgaatattgaggcaagtcaagagtaggaaaatagtttaaaactatgtttagttattttaataggaaaataatattaccctacttttaatagataaggattagtagacacaaatgtaaatatataggtgagataagaaggttctgagattctttttgattttctgttcaataaacggattcttagcaaggctgtggcttctctgttactcattttaaaagtagaaatggcattgagatttactgatgaatcatgtgctatggaacagattctgatattttaattatctcagtttgatgttacagaaagacgtcttaaaacaaattgcgtaccaattcttaattaacgacactataatatggtttattactagagttgtactgaagatacacggaggcaaaatgaaatacagaactatacaaatcttttcaaataataagtactacaaataaaagataaatgtcatctacattagtctgaattaacttgataattactttatgactcattttggcattatcactgtttatttagtaaaatatttggttagttttaagagttgaagtaacgtgttagcaaagttagtgaaattgcagaaacaaaccgtctaaccctcaaaaagtcacatgaacggtggaagctaacttgtaacaatgggcagagccatttgctactggaaggataatcagcctcaccaagtcaacttagatagtaaccttagttaagatagtcattttaatgaaaaaatggcatacatcttctgagttgtgaataagaattgtcctcaatcacatctggaattgataaacatatttttgttcagcaagcagagaattacttttgtgaattacatatttcctcaggccactcagccttcggaggcaaccaagggcttatgcatggtaattataatttgatttgattcaaaatttcaaccacgtttgggtgatcttccaaaatagcccccagtctcttacacttcacagttgatgttggaatgctctagtcttgtaggccttttgattattttttctgcttgctctgttgctcctagtttccttaatcccagtgagctactcgaccgccctcattaggctgagaatgtttattggcttaaaatgtatttgtagacccaagatggagctgtctctgtttctccactttcaaaattcagtattagtgttcacagaagttacttttcattcattccaaatttccttcaccatttctctcagaggtccatagactccttgcagacacaaaatgttctggaaactacattaagtgtggctacgaattacccctttctctgagattcaaaatatgtgtaaatttagtcttttcagtcttttttctacacaaagaagcagccctatcttaaatgccattggtagaaatgaactactgcagaatattgactctggatatcagaacatatttcattttaaaccataaatcagctaccacatagggctaagtgaggttcagagggtgtcaagcatgaatccgagatcatgacaggccttcatagaaagtgcccaactgtggcaggcagtcccttcattatacctgtccccagcctcagcattgtggtacagttaaaaagtgttttgttttgtttcttttttaccttctttcatacagtaggagcactcaaaattacctaatgtatcactcaagtgaaaaaaaaaaaaatcaggataacccactaagtcttaactaagtttggctgccttttaagtactatgttaatattggtgatgcttttccggaaacggaactgcttgacctctttcttctttattatagaaaacaaaggataatgagtcaggcagaactaattttaaatgataacaaaataatgattaaaaaccaagttaattttgcatacatcgattgatgttgaaaatgcactaataaaatgactgcaaattagacattgtaagacaagataaacaagcaaaatgagactcatctgtctcagttgcaaaatgaaacactcaaatccattgcctctatcattttgtatttatgtaatactgatcacatcaaacattattctgtttataaatgacttcatatgtgaaacaatgagatacagtggaactgtttataattctagacttctgttcagagtagaactaacaagtgtaatacaggctaaatagatagcatcagtcatttgtgtttttgtttcttggttatgatttcaagatatgtcatatctggatagttaaccgtgtaatttataatccaaaccaggaaacttttgagagtgaaagaagaaactacttatgattatgttggggcaatatgcatctaccctgagtaaaccaggacaaatagtaactttatagacttgtgtaatgaggctttattctatttagctacttttgttttgacagttttgttatattttaattcatgtaaagatgccaacaattacagaactttaaaatcagttagcaatttctaccctgtctctgtacatgtttcattgctttttttcatctattattatcaaatttcagagttctttgagcataaaagtcttcattctaacataaatagtacatttctatttggtgtcaataatacgtatacataaacccttatcttccttcatgtatattatttttttcatatcgcaagacatctttaaaatataaaagcatttttttattgcttatgtctctagttgtttttataatattgttgacttggatacataaagaaatgatcgatggttcatgatatggtatggctctgtgtccccacaaaaatttcatgtcaaattgtaatccctggtgttagaagtggggcccagtgggaggtgattggatcttgggggcagtttctcatggtttaacaccattctccttggcactgttactgtgatagtgagttctcgtgagatctgtttgtttaaaagtgtgtggcacctccccacaaccttgcttctgccccagctatgtaaaacgtgtctatttccctttcaccttctgccaggattacaagtttcctgaggcctccccagaagcataagccactatgcttcctgtacagcttgcagaaccaggagccaattaaacctcttttctttataattttctgagtctcagttattttttatagtagtgcgagaacaaactaataccgtattgaagagaatcacagaataggatgtgattaacaaatttaattcttattgagaattattatttgcaagcactaagccatgagcttgtgcagatattatctaatttttgtccttaaaaatgatgctttgagataggtatgttatgttaattttcccatagaaaaactgaagtgaaagaaaaagtttaccccaaatgacagagcttttaagaagtgaaaatggcatatagaagcaggttcttatccttactattgtgctttttttctacatttttatagaacctgcacgttctatacaatctgcaaattctatatatagctctaaaacctaaagtagaagacggcattaaaaagtcaaattagtgttacagtagccttgaaaataattctgtaatatatcgatcacaatataaaaatggaatataaactcaagttattattttagtacacatgaatatgattagacaattcatcagtttgttcaataaacaaacaaccaatatccactaggaaacaaattttaataaatcatatttcttgtttaaaaaaatgtgcttcacagaacccacaagttgttgaggtaatagggaaaagttatctgtcttaaagtttagtttcaatgtcagggctttcccagaaatattagaaatagttttacctgtttcagctcatgacaatacataatagagcctaagtacaccagctttggcagcctagaagacaacaaagtttatctcaaatctcaacttggattggaggaacacattcttttcaaacaagtattttgttaaatattttgtttgggcaagtatcttttcatcctgaagaaatattaatatattctttattaattgttatgtattaataaacaaccattattgaggcctatctcaatggtggtccatttgttaagagcttactgttatagaaagtaatcagtaacatcatccaaaaccaccctcaaattgtggatgccatacatctaaggtaaaattctaaaaaggaaagtcttccatgtttcatttattttagatccaaggagttcttctcattaacatttcccttggtctttggtgtttgtgttcctgaacctcctcttgttcagcctgatttgtagccttgctgctgtgctatgtttattactgtactaaaacaaggttactttgtacaaataaccagatgcatcctctaagtaggtctctaaggaatgccagtaatgtttcctgaaacagtcatgcattaggcgtgtgaagtctgagaaagccgatcacagggttatcttcccaccatatgaatcagatgtttgttattccttattctgctcttcactatattgttaaatgttaagaaacgattgggaagaaaggctgttaattaacaaaagacactggagaatagatcacccaaagggtagggaagccaattaactggaacagtgagaaacattgtgtgttcaaatccagaattgtgctgaagcaggcacaaaataacaacactcacaagatgacaaaatataaggtgggaagagagtcagacgaaagtagaattgtaaaaggcaaagcagaaatgaaaggtcaatccctatagagcaggttatttacagaactcagtaaagggaaatataggcttatagtaagaagtaactaataaaaaatggagagagcttccccctctgcccaaggaaaatataacacatttattacttaaaaaaaagaaaaactgtcaatagttgaaagtcactttgtcaaaattagtagcattattacaatatatttttaagtccatatggaccagattgtcaattgtaccctgtactaagctcgaaactaaggctcttgggcatttttttctatctcaagtaagcaatgtgaacaagccaaagcagttctgtgtgtgtacaaaatggctcccaccgagtatgtaagaattttcagatcaaatatcttcataatttttaacagttgtgaacaatctctatcccttttcagtttcattcctcactgatgcccctagccttgcaagccaaagagcctgtagagatttctgcggaataaacctgcccatcagaagacggaatccaatacattaatttcattaacatcttctctaaacaactggcctaaacaataattattcacagaatgaagttagcttgttagtatagacttttttatatagataatttaacatgagaaatcttgtgtttttaaatctcatgatatggtatggctctgtgtctccaccaaaatctcatgtcaaattgcaatccctggtgttagaagtggggcccagtgggaggtgattggatcatgggggcagggaggctaggccagtctctctctttttcatgtttttctgcctgctttatatctctggcagctgattagattgtgcccaccagattaagggtggatctgccctccccagcccactgactcaaatgttgtctcttttggcaacaccctcagagacacacccaggatcaatactttgtatctttcaatccaatcaagctgacactcagtattaaccatcacatgtattaagtggatgcttaagggatttagggaatactttttctctatggactgtcttcttcctagtttcttgctaaagaagccaagaaagtttgatgttactaaacttagtagtggtctcttcttccaatttttccttttctgaggcaaaaaaccttcatggtttcaccttagaagtgagtagctgtaaaggaatcttaattaaggcaaaaatctaaaatgtgtttgtttagtagtatatgtaatcacattcaatgagatccatatgtgagcaaaaagtaatgaatgcaaatgcttttagtaattgctttctttctttggttaacacatccctaacaataactgacaatataaatttgacctttgagaattatctcccctaatttcccttatttcactctctagttctcttgataccatctgttcttttccttcttcttccttttattttacttttctttgtctcttttctggaaatacattgaacatctattttcttgggtgctttcactgagcttcagtaaatacattcaatgttatttctatttattcaaattctataaatatggaattctgactacagctatctttgtcatttcgttgtatccttccatttcaattatttacagtgtacttgcctgaccccacacttactttttataaaactagaactaatatgtggataggagatgctatagtgaataaactattgtattagggttctctagaggaacagaacaaatgagatacaggtttatatgaagggtagtttataagcagaattgactcacacattcacaaggtaaagtcccatgataggcagtctgcaagttgaggagcaaggaagccagtgatggatcagtatgaatcccaaaacctcctaagtagggaagccaagagtgcagcctccagtctgtggccaaaggcccgagaacccccgggcaaactactggtgtaagtccaagagtccaaaagccgaagagcttagagtctgacgtttgagggcaggaagcatccaacacgggagaatgatgaaggtcggaagactcagtaagtctagtccttccagcttcttctgcctgcttgattctagccacgctggcagttgattacatcttctttggcaacaccctcacagccacccaggaacaatactttgcatcctttaagccaatcaagttgacactcaatactaaccatcacaactatgtttcgggtagttagtccgttgtagaaggactttccaggaatagtatgtgacatttatcttaacagtaaattggtaatgcaattacaactaaaatagaaagtatcagctttgggatcagttctcagatatcaactgtccatcttagaggctgatttaactccaggtgtgttttaaattctcttgtactttgataagcttttaaaatacattggtggctgggcacagtggctcacacctgtaatcccagcactctgggaggccaaggcaggtatattacctgaggtcaggagttcaagagtagcctgacaaacatggtgaaacctcgtctctactaaaaatacaaaaaaattagctgctcatggtggcgcaccctgtaatcccagctgctcaggaagctgaggcaggagaattgcttgaacctgggaggaggaggttgcagtgagccgagatcctgccactacactccagcctgagcgacagagcaagactccatctcaaaacaaaagtaaaaataaaagtaaaataaaatacattacttttggacagggaacatgtctttttcagttcattgatgtgctccctgcttgtctccccatgcatcagcctgcttcatttatttgtgcgatttgcctgctgataagagagtaattgaagttaagtcttcttcttccacttggtggtatgtgcttaggcatattattttgacgtcagttcttttttttctgaaacacaagactgaaaataggtttgtctgaggatctaaattatacatgttcttatatatgtgcttttcttttcttttttttttttgagatagagtctcgctctgtcgcccaggctggactgcagtggcgctatctcagctcactgcaagctccgcctcccgggttcacgccattctcctgcctcagcctcccgagtagctgggactacaggcgcctgccaccacacctggctaattttttgtatttttagtagagatggggtttctccgtgttggtcagggtggtctcaatctcctaaccttgtgatctgcctgcctcggcctcccaaagtgctgggattacaggcgtgagccaccgctcccagacatatatgtgcttttcttagaagtcatcaatgttcaatctctcacaaaaatgtgtaaacatttataaacccatttatatttacatagaatccatatttctgttatagtaacatattttacaaactattttctctctcgaaaagttgcagttagctttatttacagttatttctttgacagatgaattcctccttgcctctcaactgaaacctgtctgaggccacagtgacctcctgaattaccaaatctttgccttttttctttcatgtcatttagctttgctattatctatggccaaatatttttcctaaagcattgaaagatctcatgcttagactcaacattttttaataggaagaataaagaaaagtagtatttattaccgactatgtttcaggcctccttttaagttctttacatgcattaactcatttgttcttcaaaataatctaatgtagtagataatattagatactgttattatcatcttagagaaaacaggcacaagaagcttagtgtcatgctcaaagctttgcagtacataaataatgcagacaaattacttaaatttaagatatatacatatatagtatatataactatatatgtagttgtctgttggagtcagtctgttgaagatatacatattcatttcaaattatatataaaaatatgatatacatgtatatacatgtagacacacacagttgcagacaacaaagaacattttgggtcatttgtggtaactaggaaataactgttaatgacaaaagacagctaatgtatttaacaataaaagaatttatctgtgcaagaatgtgttgtttaggctgggcacagtggctcatgcatgtaatcctagcactttgggaggctgaggcaggctgatcatctgaggtcaggagttcaagaccagcctggccaacatggtgaaactctatctctactaaaaatacaaaaaattagctgagtgtggtggtgggtgtctgtaatcccagctactcggaaggctgaggcaggagaattgcttgaacccaggaggcggaggttgcagtgagctgagattgtgctgctgcactccagcctgggcaacagagtgagactctacctcaaaaaaaaagaaaagaaaagaaaaagaatgtgttatttagtgtaaaattaaaatacagatttggggatttggggacccttgtgtataattacatggtctcgcatgaagtctcctaaccaaagattgggaatgctaatgtagctcttagtcactgtctcagctatcattattcacgttacctctttaggttcttattttttctttgttttcatgtgttaatttcatgtcatttgcccttcactagtccctctatttttccatcatactttgttgatatgtatttctcacaaaccaatacaaaagagtaggaaaatatttttgtctacagagttaatcttgatatttatgtttatacaaattcatttgggggactcttcattggctgcaaatgctcactgggctaaatttcccataagtattttaatgcaaaatttctcatttcatttgttgtgcagatgaaaattataggctaggcatggtggctcatgcctgtaatctcagtgctttgggaggccaaagcaggaggattgcttgagccttggagtttgggagcagtctgggaaacacagtgagaccctgtctccgcaaaaaataaaaatattaacctagcacagtggcacacacctgtgttcccagctactgtggggctgaggtgggaggattgcttgagcctgggaggtcgaggctgcagtaaggcatgattgcaccactacactccagcctgagtcacagtatgagaacctgtctcaaaacaaataataaaataaaattaaattaaaattgtaagtacctttatattagtattgattttaaatatcattttatattcttctgagaagtcctcagtcaatctttggagtgcatataacatattgtagaaaccaaattcacttctgtggaaattaactataaactgacaataataaagagatgtagacaagtagaataaggctgttagaaccagaaaaaattgtagagattctttcattaaaccatctctttttaaccacataaagttgctaaaggataaaatatctacataattaaaaaaataccatcataaatttgttctttaggtattttaaggtagaaaataagaaacttaataaaaatcaaacaaataaaaatataattcaatttatagtgaacaaaaatattttaaaggcaaactcaaaaaaagcatttccaacaattttagaacatgataaattatactgttacctgtgctgccattatatcaaagtaaccagtcaattcagtcataattgaatcataatgacaaaagagctaatttattttcttcattttttcattgtaaatttgacattttgtaaaacttactacagacaaaagactgagaagatgtataattttctcacacctgtattgattatataaaaatcagtgcattttagtttatgagtaaaaaaggatttcatatttcttatgttaatacataagtgtattagtccattttcacactgataaaggcatacctgagactgggcaatttacaaaagagagaggtttaatgcacttccagttccacgtggctgtggtggcctcaaaatcatggcagaaggtgaaggacacgtgtcatatggtggcaatcaagagaaaagagcttgtgcagggaaactccagtcaaggaagtttgtgatggtttattggagacatattaatatcatcagttttaaagttgagatgtggatacaaatttatcaggtagacaaatgtttcctgaaacaggtaaatagagtatgaagaggtggagagaatataataatccaggaaatggaaaagccatagaagtatgtgagcatgatgagtggaaggagctataagtagttcaacatgattggaacataaaattcaagataaagattggcatggatggaagtgaagaagtagattggaatcttagtctcttttgtgctgctgtgacagaataccacagactaggtaattcataatgaacataaatttattttttcacaattttgtagactgagcatttcaaagtaaagttgcctgcatctggtaagggcctttttgctgcattatcacatgacaaatggcagacaggcaagagagcaaactctccagatgaagccctttataacattaatccctttgtgagggaggaactctcatgacctcagcaccacctaaaccccacctcccaacatttgcgttggggtttaagtttcaacaagggttttggaggaaacaaaacattcaaaccatagcagttgggatacgatcataaagggcaaagattttagattgatgctataggtaatggaaatcattaaagattttaggtggtgaagggacatgattttacaagtagactacaaagatcaccttggaagcagagagaagtatagaataaaaaggagaacttttgaagaacataagattactggattgtatgtttgcaaggaatactacttgaagaggctcctgtgggaaactagggtaaaagtcagttgtgctaacacagtggtaagataattataaaagaagggacaatgagataaatgaatgatggagacaggagctgtgggtgactgtcaatggaatttatgcataatatttttctaaacagatctttggtaaaattgtttcaaataccactttcctataagctgtcttctggtgatgttgctttatcttgaaaggtatgcaatttcttcttaacatgcagcagaagccatttgaaaaaaaacagtaacatataattcttttctggaaggttacttgttcttcctcccactagggtttttctcattgtcaaacaaacaaacaaaaaataaacgtaatttacttatgactacattttactcaaataaggtcatagtatacctatagctgatagattggtgtatgacatgtatttctggggaaatagatccactaataaagagtactttgtagaattgaatgtttagtctttttgtttattcttttgctttttgttttgctaactagactatgttctgaattaatcaaagttgtttgacaaagcaatacttattgcagattgtttttgtcagttttgtaatgcttgttgacattactgcaatgcaattttatgattatatcttttgaacctaaacgtcagtgagaatttaataacttttccccctatgtgcttctaaaattatataacaggtgattatactaaacataagcttcaatgttaaaaaaagcacaaatatattatgttgggggataatttacttacataactttaaagttcagcaacagtgatagcttctgctgaggcttactagatcaaatcttaaaaactatgtttctctccacctttttgcttagtttgataggagcccttattgacgtaaaatggttgtagcagttttgataactcatatcctgacataatcaaatcgagaggaagagaaggactcctcagttagactctttttgggaatgcttgtcaaacagaaactaggttgactgaatcctcaagtctgtcagggaatattctgatgggacagatgtaaaggaaataccaattggcaaaatctaaacaagccctacccacattggtcaaaccccacttttcttcaaacttgacagagaaaaaagaatttatgcagtgtcctaaagaaatccagcctttcctttgaaagaggaaaacatggatgccagaaaacatagcagccacaaaaatttaagcaaataatgcttctcctgaatacagacagaatacctactaaagaagtgcatatgtatctagaaaaatgaccatgatataatttttactaccttggctaggagtctatttgaattaaaacatgccagtgttttactctgtagaccaaacacgttctatgatttgttgtatagttctttgccaaaaaataagtgtgcagtctgaaattcaaaacaaagaatttccttcttgatccacacttcaaagccttgctacttcatatgatccttaaagaaaaaagaaaagaaaagagaaagaaaatcacaacttgctggggtctctagtatttagcagctgttaaattttaatagatgtcagtagggtactcagttaaaaagcaacccaagaaacatcataaaaaaagatatagtctttgacataataggaggcatgatttttttatagctgaaaacagaatgacaatttctctgttcaataaaataatttgaagtcaggaaaatatttaacatcgtcaagttaatattaaaataaatggaatatattttgctgataaacaagtcatagtaagcattgcttcagtctttcattgacctggttgtataatcatcaatttttcatctttggattcatatcattattttccagaaaattgtgtgcttatgttagccatacaaacttaaaaggatagcaaagaacctgaaaggtttgaactttcatgaagttaatgacatatatcaaatcaatctaggctgagtctataagaaaatcagctcattaaataagatttacatttctgaagattactcagttactttttctggatgcccatcatactgaagaatcacattattcgtatgttgccttattttaatgatttaggtttgactgtccttatatttgggtacctaaagtgatgagaaaaaatgagtcgcaatggagaaaaagatgacaaactttcttgtaacatagatgcaatattgacatattaacaaggtgaaaaaaatctcacttgcattgccaaagatgctttcgaataagttatcactatgaagtttatagcagagcagttgcagtgaacaggtgtgatgtaaaagtcaagtcattttctaagactcacatacggtatgttttgcaaatattctaccacacttggcaatgtggaagaataaatgtactaaaagctttccaatattttgacagctagcatatagtacccaactgttaatgccagtggaaagtccaggagaaagactttaattcatttaaaattaatttcaaaataatgtatgactgttattttaaaattatagaaaggcagaaatattctaaaggaatagttaaagtttctgtgtacttacatcccttgtcctactccatttccatgtctataccaaaagcaatcacttttaacagctgaggtctatttttccaggctttctctatatgtatatatcatcatttccaagacctgcaaagtcaagtggtttttataaaaccatatattacattcttctaattttcttctcttcagatatactagctctagaggaaaatcagaaaatcagaaaattctttccttcatttgtttcttttaaaatcccaaaggatatttgtgatagtcaactttacattatcaatatggacactataatttttatacaccttcatttctaaagctttatgtaaatgacatgtactctctctatattttaatttccctatctgtttatagaaaagttatgtcctatcttcttgaaagatatgaactgagggatgaataaaataatggagaaaattgccatataataacctgatggcaatattaaaataaattctaatgaagatcttcaaattattttattgcaataagcattataattttctttggcaataagcattatacttgtagttacttccagctggtacacttaagattactttttattatcacccttgtatgtaacattttttgtcatagaaattaaacattgaaataaccaatgacatatagtcaaactctctgttaggctgtgcaattccagattctagagaaaggttaggggtggaggtcccatacaatatcaagtcattaccggtaaaattttaaagatgattaaatacagatttcttgttttgctaattagccttatcccttcttattgtgttcttgttactgctaaataacttcatgttgtcgtcattacaataaaggtcacattctggtcctgttactccaggtccttccagccagctactcttgttcccaaagcccttctcctactcaggcttgcttatttcattctctgttatcaattaccagtaaaaagtgattccctgatttaaaggaacttactcctaccctgacgttataggaacatcatggtcaaagattcatgattccactgacctaattcatgtttgctactttagagagtgaagtcattgtgaaactagaacagatgtttttctctaagaccaaaagtctaaaacattttctttcagaccactggaggcacatatctagggtaaccaaggcagccaccttcagggtggttggagccagcgttcttggagtctgtttcttcaatccttttgtcatgtttcattctcacacctggctatgcagccttgaagaatcttgaggaaagaatggacttaattaagcattttaaaattatttgtatgttgttgtactaatttctgcatacatgtttagggaaacaggtagattgaaaaaaagagagtttgaagaaatcattgtctcaatgttagtcctgtttaaaaaaaattccagtgatttctgtagtgtcatactggagcaaatttcaaagtctttcgaccatcagttcaaagataaaactagataatctgtgttcattttgtgctgtagtgagtatttttgacattgggaaaatcttacaaatgtttaggaaaagtgtcagagaatttccctgacagtgcttttatggtatctgtaggttaaagttgccaggtaaaatacagaacactgagttaaatttgaatttcagttaaactacgaatactgtttagtataagtatgcccactacaacatttgaaacatactaaaacatattcactgttttttgaaattcaaattttactgaacatcctatatatttatttgctaaatctggcaacgctattacaggttgagcatctgtaattcaaaaatccaaaatctgaaatgctcacaaatccaaaactttataagtatcaacataatgccacaagtggaaaattccacacctaacctcatgtgacagataacagtcaaatgcagtcaaaactttgtttcatgcacacaattatttaaaatgcatcaggctatttgtgtaaggtgtatatgaaacatgaatgaattttgtgtttagacctgattcctatccccaagatacttcattatgtgtatgcaaatattccaaagtccaaaaagatctgaaatccaacccttctggttttaagcatttcaaataagggctattcagcctgtgtatgtggtggtatcccccatatatagaggatggggaaagatggttcaagcaacaatagcttctcaaggtggcatgttcaaattcctctaaacagggacacatgtgtatgctacttttcctttgataaaagtataatagttaccattaaaagagaaatgaaaaggaaaagtaaatatcccttacaaatgccaaaattattctaatgaacaatatgaatcaggtgttatgttttcttctcatcatcctcctcttcataatgatagtaacaataacatttataatataataattacaaataacgttttttaagacaaagcctctctgtgttatctaggctgaagtgcagtggtgtgatcacagctcactgcagccttgaactcctgggctcaaatgatcctcccacctcagcctcccaagtagctgtcactacactttatgacacaacacctggataatttttttaaaaaaatttgtatagacgaggtcttgctgttacccaggctggcctccaactcctggtcttaagtgatgctacaacctcggcctctcaaagtgctgagatttcaggcatgagcccccatgctcagccacagagaacatttattgaaagttttctatcaagcacttttaattagctgcaacttttaatacttaccctgctggagtgtatggcccaggaaggaccatatctgccctgttcattgctcatttcccagaaacccatgcagtatctgacaataataggtagtatgtgtttagtgaatgaaaaaaaaatgaataaatgaggtaggaattattatcccggtttcacaaatggataatgtgcggtttattgatgttgaggtctttcctcccaaacagaatttaagttacagtgcctaagcagaaattcaaatgtgtttgacttcaaagacggcagactgcttcaggaattaatccacatccataaggggcaggaattgttgctgaagggatatgaactccttctgacttataacatactagctcatatgcaacctgcttgcaaaagctgtctccttagaacctcaaaacaactatgtaagatggatattactatcctatttttagtgaataaactgaggcatagtgactataaaacctagatccaaacatgagtctgtctttctcagtaaaatgaataatagtaccagtgtggtaccttcatatgtaagaaaatatattgtgtttcaggaatagagacatcagaatacaattaggttaattttttgtcacgtattttacatagatgtagaaaatagaaaatgcccaatatctgtgttcctgaatcaacatttttatttatgtaatattattgaatattagacatgccacagctagttgggatccccttaattgaagcaaaatgctttaaaaatgaggaaatatatatttaaaaatatttaagaactcgtaagtttaaacaggtacttagaaaaatcacttttcctctaagtctacttactagttctctgatactaagatacaatgccatgatgaagtagttcatttctacagactgctaaactgaaaaacaactatttcagatcatgttttcagggccatagagtgggatagccaagagagaaggctgtgtttgtaagccatagtcccacaattcagtctcaaaatacccaaagatcttcctttcctcctttgcccacccacccacccctctctagccaaagagcttggggttgaaactaaaccagaacacatcatcatcattatttttccccaagttgctatttaagaagtttagacgtgcagttgcttcatgttgatgatgcttgctattctctcttgggtaaaataatcggatgtagtattaagactgtcactaagaattgttcatgtataatttatactcacaattaaaaagcatttttaaccaagtgtcacaacacagtgacaactaaattagactgtgatttacattaccatgtgctgcacttgatttagtgtcactctagagaaattgacaaacaacccatgtagagcaaggcagaggtcttagtcaagatagggctcactccccaggtgggaataaggtgagggatagccagtgcatgttgatgccattatgattaataattaatattagaatatgtacagcaatagaagtgcagcccttttagtaattgcacaagactactctagataggcatagtaagtagttaattctttttacaatataattaaaatgaaagtgaaaaagtaactgtagagaaagaaaacataaatattttctttaatgtttgaaattttttgaaaagatggaatcttgctcttttgtccaggcctcaagcaatcctcccaccttggcctcccaaagtgctgggattactggcagaagccacccaacctggcccaactgtttcttttaaatatgatgaaatcaaagttaaatgattcaagtgacaaagttgatactgaatcgccccaaaatagcttcaagtgcatttttgaaggggcctattgtcacaccatgagctgaaagagttccaagggacttgtgtgcttatttgagacatgtctggcaaagactgacttttttttttcatggaaattcaaggataaaataaaatacataaattaaaagccaaagatacaaggcatggaataagatggatattctagagaaatcacatgactaaatgacatcataatagaaatggaaaacaaaacacaacaaaaatgtgtggtggtggaagaagtgacctggaatattaaaagtcagacagaacacttagaagagaccatatatgatttaattttaattattgttttaagtagtgatgaatttggggactgtaatgtctacatgagctccaactagacatctttataagtgacaactgtaaaatctggacacaatatcttgaagcagctactagaattaaaaatattaatacaaagtcttctgtggtgtccatgttcagaagaggagttatatttgcgttcactctttctagcctgggagtagggactgttagcagtcatagatgagcagaatcccttgcgtgaaaaaagctccaattctctggtctgggaaatcaaaatatcgagtcatggcaactctgttttctggagtagggggaggggagtatctagaagaggaatatctagagatggcatccccaaatttaatctgcctgcatctgtgatagacctctgagtcgtgtatgcataaagcagagtcagagcagtttagctaaggcaaaggatctcaggtgaggaccgagttgctgtccaagactaagacaagacaaaactaactaactgaaaattactcatggaagaagagagtatccagtctccacggcttaatattcatgacgtctatgataaaatgcagtcttatgtgacataagagaagcatgaataaagagcttattctcaaaattaaaaagaaagaaagaaagtgaagccatttctgcaatagatgacttagacactgaaattagtaggaaagaaatttaaagtcactattttgaccatactcaattacataaaagaaaatacttctccacttaatgaaagatgggaaatatgagcaaagaaataataatgattaaaaagaccaaatgtatcttgatttttaaaaatgcaatagtgaaaaaaaaaacagaaaacaaaatgactaaatagaattaacagcagaatggagtcagcagaggaacaagtcagtaaacctcaaaatagatcaacagaaatgctgaaaagtaaataaacagagcctccaaatattgttagatactaaataacctaacataagtgtcattggttgtccatcagggaaaaagagggaaaggcataaatatatttaaaacgtaatggttgaaattttctaaaatttgaataaagatttatattacagatttaatgaagaatacttaaaatgaaaaatatctgggtaagcataacattctgttttaattatttattttattctttccttaatttcttaatactgcatattactgtttaaagtaaaactgtaatcattgtcttgtaaacatttataacacatataagtctaatacacatgacaacaatagcctcagtcatgactgggaataaattgacctacatggtgcctagatttctgtattttatacaaaatgatagtacattaattctaagtagacagttgtcatagtctgtccatcctactgtaactagatggcttataaatgacaacaatttatttctcacggttctggagcctaggaagttccagttcaacatgttggcagatttgttgtctggtaaaagccaactttccaattcacagacagcacgttctcactgtgccttcctgtggtggaaaggataagaggtctttctgttggcctctttcgtaacactaatcccattcattatgactctgcccacatggcctaatcacctcccaaaggccccacctcctaataccatgacctggggattaagattttattgtatgaatttgagggggacaaaaacattcagtctgcatcaactgtgaaaattaagtatgtagactgtaatctattatacaaccaataggaaattaacacagagaagtatagtttaaagccaattgaaaaattaaaatttaattctaaaatttgtacaaactaagaaaagccaaggaaggaaaaacaaaagccaaatgggaacaattatgaaacaaataataaaataatagatcaataatagaccgcaatccaattacaataaattatattaaatattaattaactgaaaatcacaatgaaaatgtacagacctcatttttatctaaataaatcagaaaaagaatagaaaataaagtgtaagttagagacaaaagaaaaaatctagaaattgagaacagaagaacaataaaaataagttattaaaaccaaaggatcattgactcttgtcaggggtgacaagttaattcattgtggaatggatagtcttttcaacaaatggtgatagaagattggcattcatatgtaaaataaggaacctctatctttatcttattcattacacaaaaattgacaatctttaaataaaagattgtagaatcaaagtgctagaatataaattgtcaatgagaagacagtggaaaatatttgtggcattgtgttagacaagatttcttgaagagcatagatacaaacacacacaacagagggaaagaaatggttaaatggactttatccaaattaaaatctattattctttgacaattcaccatttaaaaaaataaaaggtggctgggcgctgtggctcgcgcctgcaatcccagcactttgggaggccgaggcatgtggatcacgaggtcaggagtacaagaccagcctggtcaagatggtgaaaccccttttcttttttcttttttcgagacggagtctcactctgtcgcccaggctggagtgcagtggcgcaatttcggctcactgcaagctccgcctcccggtgaaaccgcttttctactaaaaatgcaaaaaaattagccagacatagtggcaggcgcctataatcccagctactcgggaggctgaggcagagaattgcttgaattcaggaggcggaggttgtagtgagccgagatcgtgccactgcactccagcctgggtgacagagtgagactctgtctcaaaaataaataaataaataaatggaaagtcaaagactaggaacaaatgttttcaaaactatatctaacaaaggatcgtttccaaaatatataaacaatatttatgattcagtaagacaactcaatttaaaaatgggtaaaagttttgaatgtgacatttgacaaaagatatatgaaaggcaaataaacatcagaaaagctgcttaccatcactattcatcatagaaatgcatcttaaagttacaatgacatacccatattaattattaaaaataaaaagacttataataccaagtgctggagaaggtatggaggaaatgtattctcatacatttctgatagaaacacaaaatgatacagccacacacattgaagtagtttgacatttaatcatacacttagcatgcgattcaacaatcttattcctaggtatctacccaagagaaatgaagacacatacctataaaaagatgtatgtgaatatccttaaaactattacctataataactaaccactagagacacaaatatccatcagctagtgaatgataaataaatttttatatttatattatcatatactaatcagcagtaaaaagtatcaaagtactggtatataaacaacttgtatgaatcacaaaagtatcaacctatgtaaggaagccagaagaatgatgaaaacactccacttgtccatatttttgatattctagaaaagaaaaaattataggtacagaaacaaacctatcagttgcctggatctgggagttgggattgagtgcaaaatataaaaggtgttgtaggttgtagttttttttaattttatttttgtggggttctagaaatgtttgatactttgtgttcatagttacatgataatgtacaactgccaaaatgcgtcagaatgttagcctagtgaatatttttgtatataaattgtatcaaaataaactatggggaacaataagctatttgcatgagcatagtcttggtattaaagaagcaagcaattgagtttcaatatagatttcttttttctgtttttgttttgtagttaaacagcatatatttagtgaatacattcaggggcattttatcattttgatttctgatcattttgccaatggaaattgtacttttagtattacttttatttagtatttattaatactaaataaaaatttagtattaatatctatacaaattaatttttaaatcatttaaagatgaaaacattttccagcagatttcaaatgttcagaacttgaattaaaatgtaattagcactgaaaagttactgtttgtgttaccctatggcaaaggctcccaaggtggttacccctaatgactagtagcgtttaaaaaatatatttttattctcattcaaagtatttcagtcttcctgttacattatggctttgtgtgtttacagagtttattctatattggtgaaccagaaacccaactttttatcaaatcagctctgagtctagaaataaaattagaaaactaataaaagtagagatgtcagggctcttgccattttcctagcagcaggaaaatcgtttatttaatgtatcacggtctagtattacagatattaaaatagatggcaaaatttatgttacagactccattttgagagaatataactcagacatatgctttcctgaaattcaccatttagaatttatcacagttaaatcacatatttatgtatgctatacacatagaacaaagactaattgctaggaatctaaattggaaaaccctattgtttgagtgtcatctgctaatatttggacctctttatattgacaaacccaaaagcagcccattataaaaatatggagaattcgtgctaaaaaccatttcacttattgcaggtctttcttaacacaattaactaaaagcatatcattttccatgtaattgtttcaacaatttcttatcatacttgattacaaaagtcattcccttccacaccctacttccctctatgtgtctgtcatttggtaagtcaagacctctttttgtaatatgaatgcttaagatgggaggatcattttattctttgacttctattctgaatatatcaaatatttatatgatcttattaaactaaatgagggttatggagtatagtgtcaccaaaacaataattattgaataaaatgaatattttcttcctctaaacagatatttatatcatgtcatatttactatagaaaattgtattataaaaaagatggggttcatcgtcttgggtttaagtagaaaaatgttctcagcagtcatcaattttttcatgaatacacaattcacgctaaaactttcacatatttgaaatcatcccacaagtctcatacttagtgatattttatttatttatttatttttgagacagagtctcactctgttgcccaggctggagtgcagtggtgtgagctcggctcactacaacctctgcctcccaggttcaagcgattttcctgcctcagcttcccaagtagctgggactacaggtgtgtgccaccacactcggctaattttttgtattttttttttttttttagtagagatggggtttcaccatgttaaccaggatggtgtcaatctcctgacctcgtgatccacccacctcggcttcccaaagagctgggattacatgtgtgagccagcgctattttaaaacattagaaaacacatggcttttcctgagaatttcataatctgatcaaggatataggacttatatgtgaaaataattatttaattattaatgataaatatgtccttgggtaaatgaaacaagaaaacaatcaattgagattgatgttggttttgaaattacaaaaaacataggaggttcaaaatataggaagaacctcttaaggttagactattccacaagaattttataaattatagcatcaaaaacagactaataactaaaatattagaatatctttcagaaacatggatttgattaaggaggcaatggaaaataattgaatttaataatgatgagggcaaaactatggagcaggatttcagagcacaaaatgtccaaaacaggccaggaagactgataataaaggaagacaaatagagctaatctgagacactattgcagggtgctgaattaccctgatttaaagttggggccaagagaacaacaaagatttggagtagcagtgatcatactaggcctactaaaagacggaaatgttgatactgcttaaccagcaaatccctgcccaccctctacctccagactatatttaagaagattgggaaggcaagatacagaataaaatcttggtgacaagagactatagagtacaacaacagagggggtaagaaaatgattgaaccattttccatatgcggtagctgggcattagaagcccccacaaaggccttctgaagaacatacatgaacctttccagtagcaactagacacctaccaccagggagcatctgcaccctgagaagctggccagagaagccatgaaacagcagggaaacaattacaactgagggaagtaaagtaaggaaatatttttctttcctcctcccccactccccttcctcatgtaatcagagcaattgcatggaggtgggcaggaggcatctcaggaccagaccatgttcatgttttctttatttttctacctgctagaatgggaggagaacagaataaacagacagtttcagatccctggagctgcagatgtgaagagtgatggtgaagagaggctgtctgaatttgaatttgttttacaattctaaactggatttttaaaagtgtttaggaagttgtaaaattcatccaatatattaatcaagatatcttctaactagcagagaagagtgatttgacataatcatatgggagaaaaaattaatattgtctcacacaaagttgataatattctaatattatagttaattttataattaattaattatacaaattaatctgagggaaacaaatccagataaataactggattttggacataaaagagagcaaaactaaaacatgcatacagctcatcattctgatagtctttaagattgtattgctatataacatttagagagataagtgggaatgttgctagttcaattttatttaagtttgtgaacttcaagaagcagtgttatataagcaacaagaaatacacagctcaagcctgacagctcttggctggagatttagttcccataggtaagaatctaattgaagccttaggagggatgagttgtgtgaagtaagacaaagagaatgataaacaaagtgataaatcttccatattcaggaggttgtaaaaaaagagagaggtgggaaagtatattatcacagagtgcaagaaatgttaatattagaaattcaggtgtctgcaaatttggaagtgcagtaaaaatcaaggaggaggatgaatgctgatttcatcatcttcaagagcagattcatttcatgaatgagactagaggcaccattgacaatttgatgacaggcgaggacattcagtgacttcatcaaggaggttgactctgaaagcaaggagaatcaacaattgatgttttgaagggacacaggaatcaggacagatgatgtatggaaagagattaatgaaagaaacaaactggcaatagccagtacagcaagggagtagagaagttatcagtgagagggtagggaggctggtcattgaaagaagcgaagtgaatatgatatgaaaaattcaggatatgaattttcagggttcagaattttctctcttgtaggacttctattcactaacattgaaaaaggaaagatatgaatagacagtgtggctaatctagacgtggacattaattggtttatcttggagggacagaaaatggaaaggatacttaacatatagtaaatatgatagttttgaaataattgcttctagtaccctatcaagaaggtcaatatagttactggtattgttctgaattatatattttaccacagtagggaggagaaactatttaggaagataaactctattatgtcattcttcattacaatcattacagctattcatgcagtcaaagacgaagaaggagtctaaaaacatcaaatggaagctcatattctaactcaagtggaagtacttaagaacttaaagagattgatatccctttgaaaatgagaggtgagaggggaggagccaagatggcctaataggaacagctccggtctgcagctcccagcgtgagcgacacagaagacaggtgatttctgcatttccatctgaggtaccgggttcatctcactagggagtgccagacagtgggcgcaggtcagtgggtgcgcgcaccgtgcgcgagctgaagcagggcgaggcattgcctcactcggaaagcacaaggggtcagggagttccttttcctagtcaaagaaaggggtgatggacggcacctggaaaatcgggtcactcccacccaaatactgcgctttgccgaagggcttaaaaaacggcacaccaggagattaaatccctcacgtggctcggagggtcccacgcccacggagtctcgctgattgctagcacagcagtctgagatcaaactgcaaggcggcagcgaggctgggggaggggcgcccgccattgtccaggcttgattaggtaaacaaagcagccctgaagctcaaactgggtggagcccaccacagctcaaggaggcctgcctgcctctggaggctccacctctgggggcagggcacagacaaacaaaaagacagcagtaacttctgcagacttaaatgtccccgtctgacagctttgaagagagcagtggttctcccagcacgcagctggagatctgagaacgggcagactgcctcctcaagtgggtccctgacccctgacccctgagcagcctaactggcaggcaccccccagcaggggcagactgacacctcacacggccaggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgtagttcctcaccagcaacagaacaaagctggacggagaatgactttgacgagctgagagaagaaggcttcagacgatcaaattactccaagctacaggaggacattcaaaccaaaggcaaagaagttgaaaactttgaaaaaaatttagaagaatgtataactagagtaaccaatacagagaagtgcttaaaggagctgatggagctgaaaaccaaggctcgagaactacatgaagaatgcagaagcctcaggagccgatgcgatcaactggaagaaagggtatcagcgatggaagatgaaatgaatgaaacaaagagagaagggaagttcggagaaaaaagaataaaaagaaacgagtaaagcctccaagaaatatgggactatgtgaaaagaccaaatctgcgtctgattggtgtacatgaaagtgacggggagaatggaaccaagttggaaaacactctgcaggatattatccaggagaacttccccaatctagcaaggcaggccaacattcagattcaggaaatacagagaatgccacaaagatactccctgagaagagcaactccaagacacataattatcagattcaccaaagttgaaatgaaggaaaaaatgttaagggcagccagagagaaaggtcgggttaccctcaaagggaagcccatcagactaacagcagatctctcagcagaaactctacatgccagaagagagtgggggccaatattcaacattcttaaataaaagaattttcaacccagaatttcatatccagccaaactaagcttcataagtgaaggagaaataaaatactttacagacaagcaaatgctgagagattttgtcaccaccaggcctgccctaaaacagctcctgaaggaagcgctaaacatggaaaggaacaaccgatacgagccactgcaaaatcatgccaaaatgtaaagaccatcaagactaggaagaaactgcatcaactaatgagcaaaataaccagctaacatcataatgacaggatcaaattcacacataactatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaactaaaaaaggcaggggttgcaatcctagtctctgataaaacagactttaaaccaacaaagatcaaaagacaaagaaggccattatataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacgttagacagatcaacgagacagaaagtcaacaaggatacccaggaattgaactcagctctgcaccaagtggacctaatagacatctacagaactctccaccccaattcaacagaatatatgtttttttcagcaccacaccacacctattccaaaattgaccacatacttggaagtaaagctctcctcagcaaatataaaagaacagaaattataacacactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacatttaaaagaactagaaaagcaagagcaaacacattcataagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacgcaataaaaaatgataaagggaatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggtccagatggattcacagccaaattctaccagaggtacaaggaggaactggtgccattcgttctgaaactattccaatcaatagaaaaagagggaatccttcctaactcattttatgaggccagcatcatcccaataccaaagcctggcagagacacaaccaaaaaagagaattttagaccaatatccttgatgaacattgatgcaaaaatcctgaataaaatactggcaaaccgaatccagcagcacatcaaaaagcttatccaccatcatcaagtgggcttcatccctgggatgcaaggctggttcaatatacacaaatcaataaatgtaatccagcatataaacagaaccaaagacaaaaaccacatgattacctcaatagatgcagaaaagccctttggcaaaattcaacaacccttcatgctaaaaactcttaataaattaggtattgatgggacgtatttcaaaataataagagctatctatgacaaacccacagccaatatcatactgaatgggcaaaaactggaagcattccttttgaaaactggcacaagacagggatgccctctctcaccactcctattcaacatagtgttggaagttctggccagggcaattaggcaggagaaggaaataaagggtattcaattaggaaaagaggaagtcaaattgtcccagtttgcagatgacatgattgtgtatctagaaaaccccattgtctcagcccaaaatctccttaagctgataagcaacttcagcaaagtctcagatacaaaatcaacgtacgaaaatcacaagcattcttatacaccaacaacagactaacagagagccaaatcatgagtgaactcccattcacaattgcttcaaagagaataaaatacctaggaatccaacttacaagggatgtgaaggacctcttcaaggagaactacaaaccactgctcaatgaaacaaaagaggatacaaacaaatggaagaatattccatgctcatgggtaggaagaatcaatatcgtgaaaatggccatactgtccaaggtaatttacagattcaatgccatccccatcaagctaccaatgactttcttcatagaattggaaaaaactactttaaagttcatatggaaccaaaaaagagcccacatcgccaagtcaatcctaagccaaaagaacaaagccagaggcatcacactacctgacttcaaactatactacaaggctacagtaaccaaaacagcatggtactgttaccaaaacagagatatagatcaatggaacagaacagagccctcagaaataacgccacatatctacaactatctgatctttgacaaacctgagaaaaacaagcaatgggaaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaaccaaagccaaaactgacaaatgggatctaattaaactaaagagcttctgcacagcaaaagaaactaccatcagagtgaacaggcaacctacaaaatgggagaaaattttcacaaactactcatctgacaaagggctaatatccagaatctataatgaactcaaacaaatttacaagaaaaaaaacaaacaaacccatcaaaaagtgggagaaggacatgaacagacacttctcaaaagaagacatttatgcagccaaaaaacacacgaaaaaatgctcaccatcactggccatcagagaaatgcaaatcaaaaccacagtgagataccatctcacaccagttagaatggcaatcattaaaaaggcaggaaacaagtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgaacacgtatgtttattgcggcactattcacaatatcaaagacttggaaccaacccaaatgtccaacaacgatagactggattaggaaaatgtggcacatatacaccatggaatactatgcagccataaaaaatgatgagttcatgtcctttgtagggacatggatgaaattggaaatcatcattctccgtaaactattgcaagaacaaaaaaccaaacaccacatattctcactcataggtgggaattgaacaatgagaacacatggacacaggaaggggaacatcacactctggggactgttgtggggtggggggagggaggagggatagcattgggagatatacctaatgctagatgacgagttagtgggtgcagcgcaccagcatgacacatgtatacatatgtaactaacctgcacattgtgcacatgtaccctaaaacttaaagtataataataaataaataaataaataaaaagaaaaaagaaaaaaaaaaaagaaaatgaggtgaaagctaaggaccaaaactttttctgaaatcattaactattttgtgcaaccacagtgatgatgatcatatttttaagacatttatacagggtagaaattatactttgaaactactgtatattatttaagccatagatgatccagggttataaaagagagaaactcagcagtatggtcttgtgatcaaatattctatcatctgatgctggctttcaccttgaaatgtgatctatgaaagatcatcttacttctattttcatgacctcatccaatcttaaaagtaaacattataagcttagttgctaagctcttgcacataatgttataggacacagaaaataaattattgttaagcattttgtacaagccaaaggtctaatgtaactgaggacggtagaaaaatccatgaataggaagcttgccaatgttattttacaaatatttgactcgaaagtttgccatagacttttgaaaatgaagaagaataggaagtctagcaattagaaacaaatctcctttgaaggatcttaacatgtaagcatttataactccttgtattatattaaaatgcttttctatttgttaaaaaccataatgagtgtatgactgcattgtaaaccatatcaatatcttgtaagtgttcagtatttaggcagactgcagtttgctgtagattaaaataatagtcaaagcatcaaagacaaacaacgtgactattttctatatttggatatgattttgaaatactggcaatggctttgatttttggaatatgaacaataattgtgaagatttttaatatatcaatataataaatatgaatacatgaataatgtattctgcaagctttattataagtcaattgtcctttcccttttaaaatagtatatttcttttctagaaacacttagctagcataaagctttttagtaatctactgctttgctccaaccaaaaacaaaacagagcaaaacactttaaaaaactgttgttaaaccgttgtttatccttctcccctttacattttttaccttcatctttttaataatctgaattgcgctaattttttacccatatgcgcagatttttcaatgttttgaaagtaggttttgtaccacaggggagaaacatgtcacacaatggcaaagtagaatcaggcaaacagattgaaagaaaaactggtgataaaaaaaagacccaaaaccaataacaactgtataatatataaattatccttattcttttgacgtgggttttaaaatttggaattatttgtaaaatttggaaatgtctttttttttaatcattaaagcaccctataaaattaaatgctaaagacccaagttataaatgacagaagtctacattcttaaaaaaaaaaatcagtttatgttacagtggaaagagatgtctgtataagtattaaccatcttaccctgttcgccattttatagattttgaaagaatacaagctggaacaaacattatcagacttatacttcttatggttaacaatccaaacttgtaatataactcaattaattatagccacttcaaagtaacatttagataatataatcatgttttgtgagaatgatatttttttcttaatcaacaggttggtactcataatatttatataccatgttaatggcatataaacatgcagaatttgtactaaaactattcaatgatttttttatgtcaatgctatagccacttttagttattcaaaatttgcacttggacattcttctagttctttagttattgatattccttaacaaattattcctaatatattccagtaattcaaagagtaaaggtacaattttaagagtcactaatacctctgttatagtttttctatcattagtgaacaatgccattcagataaaatgctgttggtcctgagaaggagtaaacaatatatcacaccacctgtatcttttttaaaaatttattttcttttttatagagacagagtctcactctgtcacccaggctggagtgcattggcacgatccgggcccactgcagcctctacctcccaggctctgtcaagcctcccacttcagcctcccaagtagctgggactacaggcaagcatcactacaaccagctaatttttgtatttttgtagaaatgagatttcaagcatgttgctcaggctggtcctgagctcaagtgatccacctgcctcggcctcccaaagtgctgggattacaggcgtgagccactgcgcccagcccctccgctaagctttcttggagtatcatgaactaagattcccttcagtcctcatcctgaagaaatgcaacccctgtaggaaaactctgacgagaaagtcagaaaagcattaagttaagcacatagagtctgatatacgtgtgctgattccagtgcacaaagttgttttgacatccagggatatcagtcagggaaagaggataaggaaagtgtagatgagaggcatttgaaacagaattcccaactgtccatattatcaaagtctatgcaaatttcattttgctgtggtatataataataaataaattggggcatcctatttaaatttattatatttatttatggataatattaaatggtgtattcatgatccaaaattaattggagcattccaatttggatattttgctgttttcctaagaacagaaattgatgattgacttaaaacatccatacatttttaattattggtaattggagaaaatgaatgtctcctttaaatttaatcaatgttttttaatcatctaataataggttcttgatatatccatttgttgatgagataatcccatctacttagaattcttctgcttaatcttaaaaatactgagttcaagcatatctttttcattaaactatgaaaaactaagctcatcatataatgtttattaataggacaatcactaaaggaaattaaagaaaataatcaatgattttctgctaagatgctaaagtagatcctttatatttatagactgtggttctacaggtactctgaattataatatgtctttttggcataacagtaaaattatatttgtcagattctcttgttatttttgctgcagtaggagtgtgacattttgccatttcttttaatttgaaagatctttaaagtctattctacagtaaggaaggggatgatatttgacttgtattcatgtgtcatcatattttcttattcttttctattgatatacaatagttgtacatattttgggggtagatgtgatatgttgatacatgtatacaatatgtgatgataaaatcagggtaactgggatatgcatcaccacaaacatgtatcttttctttgtgttgggaacatttcaattattttcttctagacatttttgaaatatacaataaattatagctaactatagtctccctgctatattattgaatactagcttaatccttctaactggttcttttacctggtccccaacttttcttcacccctctccttcctccacccttcccagcctctagtaaccaccactctaccctttaccaccatgagatccactttttcagtttccacctctgagtgaaaacatgcggtatttgtgtttctgtgccaggcttccttcacttaacataatgatctccagtttcattcgtgttgctgcaaataacagaaatttattctttttttgtgattgaataatatctccttttataaatgtaccacgtttcctttacccgttcatctattgatggacgcttaggttattcacatgattattgtgaatagtgctgcaataaacatgtgggtgcaggtatctctttgatgtactgatttcctttcttttgggtaaatactcagcagagggattgctggatcatatggtagttctatttttacttacattttcccaatcttctgatcagaaaccatgaattggtacaaagtaaggttcagaagtaaagtagctgttggggaaccagatgcattttcttagatggaactggaactgctcagttgcataaagaaaagaaagaaaagtgtaattaatcacagcatctcagctaaatactggaaagaggcatttatggctggacctgatcaagacaacatggatagtagaataatcttgtaaatatgtattgcaattattttcataacatactaagtggctgtgtcttgtagatatggcagtgggctgtaatgcaaaactgtatgaatattattgccacccacagctggattccctttattttacaaacgtgttttgacacttatggctaaaatggttacacaagtaataaatgccacactaaacaatttttattctaatgagcatttcttcagaaatattcaaagcaaaccatttttcatataaatctatatttgtttttaataatcagaaaaaagggtaaaaactgcacattacagaaaaaggataggagaaaatgtcaaattatatcaaaggaaattgatgaattttaccttccacacacatattagctgttgctatcgttgaaacagtgtcttttcagagaaattaggtggtaatgaaaactttacatttctagtttatatgattcaactaatgaagcagtactacatattatgtttgaaaaaagtatggatttagcacaataaaaagttaatgatgagatacataccctcatcaacacttccttttcaacacaatactcaggaattatattcctgaataaatggctcagctcttttttaactgaaaaaatccaaaattgaaatgtaaaaatgcattttaactaaagctactggagttattaacatggttaaaagtactcaattctggattatttctcttgctattgttataaaggctataaaatgaaatggaaatgacagaacaaaaggaaataaaacactaacaaaatcatcaaaacactatagagcagaggactgtaaaggtcccccacacatgacataggaatatagaggtaagtaataaaacacccctagccgttgctagttgggttgtttgcccaggaaagttccctttggggttttatactaactacctgtgaaatatctacttaaaaagaaagagacctatattccactggttgacagtggttatcccgacaagaaagtggttattttcaacaagaaaggaaaaacaaaaccaacttcagtgcatttacaggttaaaatgtaagatactgaaaatttatttaatattaaaaggaaaatgtacttttttttttttttttttttgagatggagtcttgttctgtcgcccaggctggagtgcagtggtgtgatctcggctcactgcaacctccacctcatgggttcaagctatcctcctgcctcagcctgggattatagacacgggctaccatgcccaatttttgtatttttagtagagatggggtttcaccatgttggccaggctggtctcaaactcctaacctcaggcaatctgcccgtcttgtcctcccaaattgctgggattacaggcataagccaccatggccggccaaaaatgtacatatttatgaataaaataacacttaatatattaacttccagaaagtaaaaatgataaaaaaaaaaaaactatgaatagtgattttagagacttaggacaaatttttgattcaatattttagagtatttttttacacagtttgataggatcttttattttaagctggtaatctgaaaactgggcatactcagaagaatcattttcagttatatttaatatgttggtataatagatatcagtttatatataaatatttctgtatctatttttctggacatgtatatatataaaacttatttgttataaagggaatatggacaggatatcgatacagatttttaaagttcgaaaaaattaaaaacatgggctataacttataattgaattgttttaaaataaatttcctataaaaatgtatgttcatatatcttcttaccctttactgtaatttattgaatggcacagcatcattttatgtaattaatgagcattggaagacaaaagactccagctttacttctgccaggcattacctagaatttctaattaggcctatgtaaataaatgcatggatgtatacatattgtctgtagttaatcccttctgattaccctcattcattatatgccttcttggaataactgacgatgatgcttcctgtacgtaggggctgaatgcaacctcagaaatgttctgaacctctctctgactatatgatactaaaaatactaaagggagtgatagtgattctaaataaaatattttttatcttttagttttgatcttaatttgtaaataatcatcacaatgaaaactgaattatttatctgatactcaagtgctagcaaataacatttttcattacactgctttcccaaatgtattattttagtatttctgcatgtgtaccacaagaatttgttaaaacatttgtgaataaagtattgttaaaacaaaaaagcatttacatgtagtatttcattttttgctagtttagtgtcaaaaaaagtaacaagtaaattattttttcacagctgaaattttaagggtcagaaagcctcatttatcacagattattgaggagaggtgctgtgaacctcagtttctgctttttcccaacacttggacttctgacttttcacataacttttgtatctgtaaacaccttaattctcgaaacccaatgtttatattgtaactgatgaataaaatagtgaattgtagggagaaatacatatgcaaaggaaatgaagattttcttcttttagaaaattattaccatttttagaacataaatatgctagacaaagaaacatacatgaagaggcattaacaagcactatcataagcatttcttattcatattctacgtttgagatatcattctttttgattaaaaattaattattgattatagttacattgtagatttgttgagatagatatgatattgtgatacatgtatacaacgtttaacatataaactaattacttagttttgggatctaaaatatctagaaaagagatgctgaaaaaaaaagcaaatactttgcagacttagttgtattttttgtctcctccactttgtatagaagctgccatattttttgttataatcacaatatatgtcatgacatagtgcaaaggctttcacagcttcatgttggaaatggtatttgtggaaaatagtaacttcaaaggcttatatgtattctttcatatatactgctggaaatgcattggaataaatcattttccttgaatgatgaaagtatcaaaaatgtaggtgcgttcagacataagtctgacatgtactttgacttttatctcattaaatctttgctatgtttgtacaactggcttcctttaatatttcagacccagaacttaagccccaagtcaaagtgtgaagtgagttaatctattcagcgcttcttcatatgtattttgaatgcatttctatttccagacttcttacttgaacattactttaggggaaaaagtttcatttttattttaaaatgcagggaattataatatgttctggatttacaattctgtttctcattttcttggtgtaaaggcactttgttattgacccaggggcagctacatagtctctctatatcttgaccctttcagaatctccaaaagaaccctccactaaagcttgggtaaaggaatagaagaaaatcacctttctgcaccacccacgcagggagagtttagggatgtcagtaatggtattgatgaagacagatgatgaatgtgggaagtgagaaaaaataaatacaacagaatttctaccccgtgtatctcttcagggccatcagggtttgtacatttttatgattcacatttctggctcaaacttcccaggatgagtctgtcactcttagaaccatagaagtaatttcctaagtgtgattatgtgaataacttagttgcaaattcgtcagatattaaaagagtgggcatatatgtttcacccttattccagacatatctattgtccctttcccaaaaccacagtgtggggttccagaagcaaaccaaacaaaaaaaaaaattaaggaaggtgagcttggcaggttgctccctgctgacttaaatattctgctaatttgccaaggatttgaacccaactttcagatatagctaaggctccataagaagcctttgaatagaaccgtcatcttaataagactaagtaaatcagatgagtttcatgttagctcagggccatttatcagcttgaagagtgttaatatttcatgtgggtctagcaatgacacctaagcaaagttgggtttggagactgtgaaacagctactacttatttctcttccaaaatattactaatcacccctccccacttccaccaacaaacagctttctatctggagcaaactcatgttttcttcattttaagactgatgaaaggtctgggagtcccaaaacgatttctggggctttcatatttctaagtttactagcatgttttatttatttattgaacttacaaattataatcagaaggctgcttatacacttagatgtagaaacaaccaatacaagtggaattactggcatggttttaatatactaatgacattatatccagatattcaactatactcataatagagacacacctaccacctgacagaagagttgacaccttctcagagagtacttgcccaagtcctgtcaatatttgcttctatgatagctattttttgtatcaccaaaagcatccaaacattttttaatggtagggatatgttatttcttaacatatgtaacaaattctgtcaagtcatagaacagtactcattgcctgggattcactgatctctttaataggagcttgcatatcttcgttttgttgtgctgatttcatagaacaattctcagacaatagtcttgtttctttaagtttcaacttacgggcgttaagttggccctttgggataaaacaaaatatacatgagaataaaaatgaatcaaatgatgaaagtatcaaaaatgtaggtgcgttaagatataagtctgacatgtactctgacttttgtctcattaaatctctgatatgtataaataaaataaaaatgaatcaaatttataagcaagagatacagtaatatgatgtgtcatgttctgactgagagaaatccaactcaaattgtcttaagaaaaaatctcataacgcaaaagagtagtggtaattctttagacactaagtgatatcagatggttaaacagtgttaccgagatctttctcccggaatatttaaaacctctgcacggtgttggtaggaatgcaaaatggtgcagccactaaggaaaacaatatggaggttcctcaaaaaattttaaaataaaattaccatatgatccagcaatcttacttctgggtatttatccaaaataattgaaatcaggatgttcacgggatattagcacttctaatgttcatggcagcagtattcgcaacagccgagatgtggaaacaacctaaatatccatccagaggaataaagaaaatatgttagatacaaatcatggaatatatttagccttaaaaaagaaggaaatttcgtgatatgagacatgacagttgaaacttgaggacatatgctaaatgaaataagcccgtcacagaaagacaattactgcatgattctagttatagtgtgtatctgaaatagtcaaatctatagaaacagagtagaatagtagtaccaggggctgtggggagggggaaacagaaagttactgtactaatcaaaggccataaagttgcagtcaagcaagaggaagaagctctagatgtctggtgtacaacattgtatctatcgtcaacaataatatattgtacacttaaaattttgttaagatggcaaatatcatgttaagtgtttttaccacagatgaataaaagtcagtcttcttcatcttccttaagccctgtgtggtttcattctgtttggttttatttccaagcagccttcttaaatgagataaagatagccaattagcagctcctggtttagagacataaaacattatccacacaagcagaaaaaaatgtctttcattttagttccttcagagatttcagggttgactctctatgattttctgacacatgctcatcccccaaatgatctcaactttcattatgtatgggtcagagttaccctaaggacttgttagaagacggattatagagccccagtaccagagctagagcgggtcccaatagtttgcatttcaaacaattagtcagatgatggtgatattagatcaggaagcacacattgaccaccacttcctcttagtggcaggatacttataggcacctgaaaggaagaattcagcatcatttgcattatacaaagcaaatatggatgaaatcatcttccataaaaaaatcagaatggtaatgtattctcaacaaaaaaaaagaaagaaaggataaagaagtagttattactcttggtagggcgctcagcagagaagcaaccacctctacccaacactacgaaggcctttccttctgctctcctgtttccctctgggactgtaaactagttcaaccatcgtggaagtcagtgtggcaattcctcagggatctagaactagaaataccatttgacccagcaatcccattactgggtgtatactgaaaggattataaatcaagctgctataaagacacatgcacacgtacgtttattgcggcactattcacaatagcaaagacttggaaccaacccaaatgtctaacaatgatagactggattaagaaaatgtggcacatatacgccatggaatactatgcagccataaaaaatgatgaagctggaaaccatcattctcagcaaactgtcgcaaggacaaaaaaaccaaacaccgcttgttctcactcttaggtgggaattgcaaaatgagaacacatggacacaggaaggggaacatcacacaccggggcctgttttggggtagggggagaggggagggatagcattaggagatatacctaatgttaaatgacgagttaatgggtgcaagcacaccaacgtggcacatgtatacatatgtaacaaacctgcatgttgtgcacatgtaccctaaaacttaaagtataatttaaaaaaaaaagaaaaagaaaaagaaacagtttagggatggcagggaaatgtgtttaatattatgctctgtatttcatgtcaataataagtgtaggagtcctaactaactagttatagaatttatccaggaatatatcaaaagagtaaaataatataaacaagaagagtttatttcaggaatgcaacacatgtaaaagtacatcatatgatgaacatcattaacactgaaaaagtattttacaatgtagtacatcaactccagaaaacaacaataaaaatacaaacaaatagaaatcaatgtataactccttaatgatcgatacaaatacatacacacaaacacagtcatatactctaatttcctgacaccattttcaaagaaagaatattcataaaaataacacccacttaatagaaactggtataaaacagtgtacacatatgaaaagcatctctatccatatctttataaacatattactatggtagacatacaatcttgaatgaattccaaaataaaaatcacatgtaccaatatttacttttgactccttcagttgtattgtatgcgcattgtaaaatctatctcatacaataatttaaggtattgtgtattttcatctgtgtcatgtctaaaatgtcatgactggcatgtatctttctaatgttatctagtaattagaaataataggataccaatgtatgaaaactgatgagtcatgctttcaggctttcatgtctattttttaatgcctttttagttacaaattgacaacaatttgtaattaataaattatgtaccagtaatcaaagccaatatctcattcggagcagaaaagaattactatgattttatcaataccagatgaccaaagtaaatacttactgactatgtgtcgaccatgtttttgttttgcttttaggataaaaatacaaagtgtattgatcaattaacacacatgtacatgcacataactatctgtctcttctatccgtctatctaccttgtacctatgcagtgtgggtagatagagggatggaagagacagatagatacataaatgcatatctatacacagtatgcattagcacacagtcacaggtatacttggcttataaagagcacaagatattatgccataggtggcattatcattactctagttaatgaaacatatgaaaagattattgtatcttcaattgtattctagggaaaagctgcagaaatttacagccaaaacaaagctatgaaattcgtcaattgattgtcaaatattctgagaacaatttttattgcaaattatttcttcaatttctaattttattaagttgatggtgctctcactttcaaaggagctttaagatacccctgacaagtagtttttaaaggacatcttaactgctgttactaattcacctagtgcaatccttcatttaaaaaaagtcctgctggtttatcttaaaaaataaatctttctaaagtttccaaactctatatttgcttagagaacacaaaggggaaataaaataaaatatatattatgttatgattatttttcttcaaagaaaagctgggttaaaattctgcatcatttttatggttgtccaaaagcttctaattttgtaattctataatatttactatccctgccattaatttggctatgacagaaattatagtttcatagtatgtgtgtgtgtgtgtgtgtggtgtgtgtgtttgtgtcttatgtgaaaagcaattttgtgtggcatatttattcacactggtttttcttttgtttcctttcatggggctgggccaataagcttcttaatgatgactttaagaaattcccatttctaaataaaaggtagttaggctaatacgctgcctttcccttactgataacatacctaatactaagaatatccattttaaattcaattacagctaactttgtgacaaacatatggtatatttttataaaaataattcatcatttataacaacctccagaaagtgaatcattgctgctataacttgataacaatgtatttcaccttttaaaaatgcattctgcacaatctggtactaataagaacattatcactaaatgtactggataagggattcatgaaatagtgacacatatttttatttattgtgtgtatttttttttttacattgctccttttaaactgatgcattagctgagttatatgttcaattattcattctgagtttttctctgaattctcttttttggaatattgcggaataatttgaggtagtttaagggactcactacacctccttctgcatattcttagactgggaccatggaaacaaactcaatagaattgtttatttaatattgtttttataactttagtatttattttcctgatttgaaatttatttttattaactgctgattacattataccttactatttaatatagacctccttttaaatgctaataaataacatattatgctttgttttatatttatcaagacgaatgatgaaaccacattcaatgttttattattgtttattgtctcaagatacataattgtatttacttactccaaaaccccaaattacttcattgctaaaattacataaattgttgtgtaaaaatatctaagaccaaaaagcataaaaagccaggagaaattaccacaaatataaataatatttatatagagagaggataggaaggaagtagagagactgtaggtcaactactaaataaatatggagaaacaccaagttcaaaatattgatagaaacagtctttaaagcagttttgttctctttgttttgtttcaatttatggagagttcttcataataattctttttcttgactactcgttagagacagggttgacttgcagttttaaagaatgtactgtggcactgggtcagtgaaatgtgcctgttatggtgttgctgactatagacgaggctgagtttcacttcaataccataaccactgagctggatttctgttgaccctgactttgtttttttttttttttttgagacggagtctcgctttgtcacccaggctgcagtgcagtgatgtgatctcggctcactgcaagctcagcctcctgggttcacgccattctgttgtctcagcctccagagtagcagggactacaggtgcccggcaccactcccggctaatttttttttttttttgtatttttagtagagacagggtttcaccgtgttagccaggatggtctcgatctcctgaccttgtgatccacccgccttggcctcccaaagtgctgggattacaggtgtggaccctgacattttttaaaaaggcttactggaattatatctcagtagccatttgcaactcttctccttttagctaccaggacacacaaaaagtattgctgtgtgtgtgtgtgtgtgtgtgtgtgtgtgtgtgtgtgtgtttgaagttcttcttgctcttgtttttataaaattttcaaaaataacaataacttaagaattagcttattcaactttactttaatgaatgcttatctagtttatccaatcacagaaacaggatattactataaggtacttgaagaagtttatttaactaggatttttttctaaagtaaatacaacaaaattattggttgaaaataactcttacttactgaatatctctgagccagaaatgattgtagatgctcaggatgtagcagtagaaaaaataggcaaaatggtccctgctctggcctctgggaataaaagaactaaacacataaattggttaaaaaaaatacaccacacacatacacacacacacacacacacacacacacacaaacacacacacacagagtttgtccagtggtgatgactactataaaaaataaataaatcagggaaggaacataaaaatttccaaaggaccagagaggagtaagtgcagtttcacaggagcatgagagatttgctaaaaaagtgacatttgtgcaaaaacgttatgaggtgagggagctagttacaggcaaaatgcaaaaactttgtggtgggagagtgtttgacacattcaaggaagagcaatgagacctgggtggaatgatggactatttagagtatttatataaaagggataagatcatgtagagacttttgggccacacagcaaattgtgatataattatctatgtatctgcccttttctttttgactctgagttctggaaaagcacgatcaggtgctattcatctttgagccaccaaagcatagcacttgcctgtcacagggaaggtattctgttggcttgaagtgagatttggatctcaaaaagtccaattctccttgtttatcagaacatgactagaagacagagtggcacccatctctacagactctggttaattggatggggacactgtataaatttcctgtggctgttgtatcaactataacaaattaggtggcttgtaacaaccagtcaggttgcacccacacttgggaggagacgattacacaaaagaatgaacaccaggaggtggaaataatgagctccacctgttgtctctccagcacacattgtatcttagaagctggaaaactccgtgggcacttatccaagcctagtgggttagggatggtttcctagaagacaccaaagatatgtgaatgaaatgcgcaggaaaactaagctttagctcagcaaaagaaaaacaaggcagagaagaatgctggagcaaatgtattgatgcacaaacaggagcatatgcatagagctcctggtaaagggtgagcaggggctcaggcagaagccaggaatcaggtactggagagccagacaggatgctcaagaactcaaatgcctagaaggattttacctaaggatgtcgcagtgcctgagatatgctttttaggtagaaattccgattaaaatatgaaaagggattcttttgtaaaaactagaggcaataactgtggttaggaagataattcagtgatccagccaaagataatggcctgaattaagacaaaggaagtagaaactaggaaggagaagagagtggaaaacctcagggaaccgtaagaacaaatcagagtggtgattcattacacttagaatttggggaaaaaactaggtgtctaagacatcccgctgagatttcaggcttgtatacagaatgaattaaagaagcaaccttacttagactttgaataatttttattttgatatatttcatttataccattttaagtgactacatctccattttagaattgttttctgggattatgatgagggaaaatcccttttctagcaatctttaatttgaagcttcagttgtcaacacagaagacatctatttaaaaaattaatgtgaaagaagcatttgtttttctttgtattgatgataataagtaactaggggaaaaactctgagctacttttacttaaaaataaatatttcttttagagatgtgatcatcataaataattagatgaacagaaatataaaagtacttcttatatagcttttttaaaatacacttccagcatttatgtggccaaaaatacttttttaaattcattatttaaattttcaaattttaattatgaggcatctgaaattttacaaaaatattattactgacacacatgtgcacataactaagattaaaaaatgttaaccctatgccttatatacttcacatcattcctttatcgaaagacataaaacattacatttatctcaaccttctcatccctcctcaattcctcaattaaattatatgcttaaattgctacaaataatatctacttatttttatatacttttatcaaacatacttatttcatcagttatctatattgccatttcaattttcaaatgacatatagtatgatgatgtgcttgttatttggcaatgcaatttttcactgaacatatatgtatacttttttacatttccatgttgtttcatgtagattccaattcagaaggctattgtatgtcctctccacattaatttattcattaggtacagaaaacttgtcttttctactgtttctctaatgtgtctctgtacatgtctctttgtgtattaatgtgttagaattccaactgctacttatggaatttttagattttggggtatgtacaccttcaactttgctaggaatccagaacacattccctggcttccatgaatataaatgagttcccatttcctgtctcttcactagcatttgttatttaaaaaacttacaataaaagcattactatctgttggatatgcaggatatcattttcttcataatttgtatttactttgcgacacagtactccaaacattatttaatgcacttcttgtccttttggtttcttgctctgtgaatttcatgtctgtatctttgcttatatttctgttgagatatatgttttccttcctgattagcaaattatttttattttctggatactaactcttcgttagttttagcttttgcacatagtttctactttttttgtatgtttaatttttgtttgtttatgacattttgatgtttttaatccgcccttaaagatctcctttgttgatgttgttaaaatggtcctcatatttcttttagaatgtttagtttattttaacctatacgtaattttttttttctgttgagtgttaaggggtggtgatttttttctttgtacataaggaacagctacctgtttcagcacaattcatgaaacagtgctgacatttccactgaaataggaaaagtgtctagtatcttcattctgttccattaagaaaattccatgttgttttaagaaatatacatttataataaggtgttttaactgataagatgccttcttcaatgtatctcaattatttgaaattatattgttggtgctttacttttctttttttgttttttagaagaagagtcagcttgctacattttaacaataatattctgtagattgaggtaggaattgttttgaatttaaaatttccctccctttacagaactgagtctatgattaaaaatactatagattttgtgtttttcaatatcattttactattatctgatatactttgattatattataattagagtaactatcttggtgtcttctatggtttctctgttctctcataccctatacacatgccaaccaaagttcctacattatgtcattaggctgtgcaggattctagccttggcaccccttagtcctcatttcctaccactctctgttttgtcctttctcttgttctgctccagccacatgggtcttcttggtggggaatgtgaaaatcacattcctgtctcaaggacattaaaatttgtgattccctttgcttggaataccacccagcatctccaactgatcctttgcttgtgtattccactgcacagcccctgcagctgatctttgcatggttgtctctctcatgtcattcagatctcagctcaaatgccacagtcacacaaagttctttctttacctttctttagttccttgcattaactttggacgccactcgtcattacctatctattcattacatatgtttctttatttcagaaaaattaccactcactagagcttttagttcatgattgtattcccagtattaaaaaatgactcagtagcctctcaataaatatttgttgaaaaactgaaagaatgaagaatctactcttaagtgccataaaattattttaactatgttttttcaaattatatcttcaaattgttattggagaataaaaccatgggtgatatctataaaatattatatatgtgagaagtgtttagtgcaaaataagtagtgttgtaaaataattttatttattaactcatggaatcctcatgacaacaatatagtcactattattactatttcttcttaaaagatggagagtttgaggtcagggagtttaaaatttttcttctcatcacttaacagtaacgatggagtcccttggatgcagtggagccactgtgctgtcactccagtgcctggaggctagaacacagaaagagtggttttaaccacgatccctggctttccgcctaggaaataaaattaagaaacagctagaaaattttaagactggaaggctatcaaaaatacatgaatcatgttcattgcttatgtatgacaactagctttcccatatcctgttaactttctctttcatatttaaattgtacaaaggaagtcatgcaccttatgacaacattttggtcaatgacagaccacatatgcaacagtggtcccataagattataataccgtattttactttcccctttctatgtttagataggtttagacaggcaaatagcactgtgctccagttgcctacagtattgagtacagtaacatgctacaggcttgtaggctaggagcaatacgctataccacagagcctaggtgtgtagcaggctgcacatctataccatctgggttattgtaagtacacactgtgatgttcacagaaaaacgaaatcacctaatgacacatttcccagaatgtattcccattaagtgacacatggctataatataagaaattataccacaatagaatgcatcattaatatattctacatttcataatcacatatttttatgaaaaatttactatcacagaatatcatttgccacttcattttactgttattattattatttttgagataaagtctctgctctgtcacccaggctggagtgtagtggtgcaatcaggactcactgcagcccccacctcccaggctcaagccatcctcccatctcaacctcccaagtagctgggactagaggcccacgccaccatgcccagctaattttttacatttattttttgtagagatgggatctctctgtattgcccagtctggtcttgaattcctggcctcaggtgatcttagtgcctcagcctaccaaagtgctgggattttagacgtgagcctccattttattttatacataaaaggtcttacaatcgtttaaacattaagactccctcaagaatatcttggtgatgtgagcacaagggccaactagacttgcctggcacgccccagacccccaccccgccatcaacacaaaaacccaaagcaacaaatacacaactgtattttacctggagtgactgaggaagtgcactggagagtacccacatggacctgcacaacggcgtggcctcgagcagctagccagcccactgtacgtgctcgctcctggcttggcagccaatctggtcagaccgcacctcattgcagagagtgctgcacagctgcccagccccatgccctggctgccctgctggaggcattcacacgcacccacccctggcctgaaaggggccctgccttcctggagagactgcagcagccacccagtcccatggtgcctgtgcaaaccaacacccaggccaacagcgaatccagcagcagccccagctccctggaaaacgcgagacagagctgtctggtccccctgcacttgcactcacacctggcccaacagccgggccaatgtctgccccgtgtccccagaaaatctgtcactgaggtgtcagccccactgaatgcacctgcacttggcctgaaagctgattcagaagtgaactagccaccccacccccgctagtccctttgcacctgccctgaacatgcctaacagccaatgtggcagtggccagcctcctggatataccaccacatacctgcacccaaccctacagccagttggctggtgacctccacatcccaggagagcacacgcgacagcctgtgggtcctgcacaccaatacatgcccagtccaacaatcaatgtggcaccttcgcctccagcgaaaccatgccatcaccttcacaaattcctgtaacctaggccacttgggtaatcgcagacctcactgatgaaaatcacagctgaagaaactgcaatgaagaccatgctactgagtccacccagaaccacagcctatgcgccacactcaacaaacaccctaggaagcatctacaagaaagagtctcaacaaagtagacataggaagtatttaacttaacacaataaaagccatatatggcaaacctacagctgacatcatactgaatggggaaaagctagcagctttttctttaagatcaggaacaaggccaggcatggtggctcatgcctgtaatcccagcaccttgggaggccgaggtgggcagatcacctgaggtcaggagttcaagaccagcctggcaaacatagtaaaaccccatctctactaaaaaataaaaaaaatagccaggcgtggtggtgggctcctgtagtcccagctacttgggaggctaaggcagagaatcacttgaacccaggaggcagaggttgcagtgagctaagatggtgccactgcactccagcctgggtgacagagcgagactctgtctcaaaacaaacaagcaaacaaacagatcaggaacaggacaattatatacactttcaccacttttattcaacatatgactgaaagtcctagttacagcaattaggtaagagaaggaaatacaagtcatccaaattggatgttgaagttcttgcttaagtctttagtgggaatctcttgagaaatgcacatcagagtaacctgctagcttctctgtttttccccagaatggtttagtaatgccatttggtttgaattcctagtagattcataaagaatttctccagttctgcctgcaagtggctattcaactacaccttgccatttaacagtgtcttacacttttatttcattagtagtattatttttagagacagggcctcattctgttgcccaagctggagtgcagtggtgcaatcatggctcactgaagctttgaactcctggcctcaagcaatcctcttgcttcaacctcccaaagtgcttggattataggcatgaaccaccacaaccggcccagctttcactcataatatgggtctagtccagcagaattttactgagcacccttgattgcagacacatagaaaagtatcccaggacattcttgttgacagttctactgtggattaattgaaaatttgtatttatatgtgaaattacagatttaacatatgatagtcactttcctgtttactggtgttctaatgctgatttttaagttaattttaaatttccaactattaacgactaaaagttcaattgcagattagtattaaaaccaaggattatatctatcactgctttatataaaaacaattgtcaaagaaattctgatactgtgtggttagtcaaatttgaatatcaactagatgttataacatgatagttaagaggatgaaaattgtgctttatccattcctgcttacttttgaactgtgttcagtatatttcagctgtcacttgttcactccattataagaataattattaagaatgagctgaaaaaacacacagttcataaaactaaaatccttaattcacatttgtatgttgtgagttaatgaaatttgttttcaaaaaaagcttgatttcagaaaaatctaattacattgttatactaaaagttatcagctttatcattatttaatggaaagtaataactgatagaactgtttatagtaatatattatagagtgatgtttttcatttaataagtttgttggagaagaagacaacatagaaatatttaatgggggctgcttccctagagttaaggatattttttgtgagggtgactttaaataatattttagaaaaatataggtataggtgtgaaaactataactgctttccaatagcataaatagcatacactcatactaatagagtacctttgatggcatatatgtcctagtctttcaagtcactactgttttgtcaaggttactacaacaattttgaagcttggcaaatgaagttacaatacataacctggtacgtgcctttttttccgtagtcaacaaccaaaaagtgaattgtgcttggtggaaaccgagtgttgtaaaaaaataaaagattattgactctgttcgttatcaactgtgaacagctgcacagggaagctggaagccagtgggcccgccaagcacctctctgagactgaagccatttggagccaggttggaagcagcgggagtctgaggtgtcttgtctagacagcagaggctctgtatggctcttgaagaaatgggcaaaggactttatagagagaaagtccttccagagttcttggcacaaattcatctacctatttcctttttgtatgttactattaaaatgagtagagaaaccaagacacaaaataaatcaatgggatgtttagagaatgaaatagaatggtatacacatctaagtttagaacttcaagaaaccttggcaacataccccaatttccttattttatacatagcaacacaaatgtccagaatagatgaataaattgcatctgataatacaattggatcaccagggatccggaatgtgtatctaaattgctggcatccatattcaataccttttccaggtgtcttaaatccttgtgctcaaaatgtgatctgcagagcagcagcatcagtatcacctgtgtgtttgccagaaattcagaatctcaggctcattcatagacttatgaattagaatctccatcttagcaagattgcctgtgtatatgctgtattaaattattgaaaagacttatgaatgataactatgttcttgagtgataaaggtggaaaattgcgtatgtacagtaggaaaaaatcttcagatcatccatccgttataacgtttagttatatgtggctagcatttttgttaatgtcagccacttgtttgattttaaatcagtccctctcttaatacggtaatttgagctcatggtaaaataagaatatttctgtttttcaataagtataattttaaatttatagaaagacctgggtgctgtcaaaaattttagtttaagccataaaataaacagattttaattaaatgttttgttagctttcatatagacaaatgagttttagtttattttctattgttgtctttactactttacaaacataaatattgaaattactcaagtatctataaatgagaaatagttataagccaattaattgttattaactgattcaacaaatattaactttaggcactatgctagatagatatatagtttattagggatttatttagactattttatttcacataaaattctgcaaaacaatttgtgttgtatatttacttaactaagacagttaacaaacgattatgattggagataaaatgcaagaattattttaattattttactaattttttttctcttgttataatattggttcaggttaactagtagcagtcacacgaattataaacatcagatttactatgtcatctctctataacctatgattccagagccagttttcactaatagttactcaagattagacagcatttagaaaattcagttaatattcttttagtcataaaatttggaaacacattaaagattatttatagactatagttttttctcttttcaatgtaggggttttcaaatgttataaacaccacgggactttttaaaatttacattcctggactacaggttaaagtttttggcttcattaacttacaagaatctacttttaacatatcttctgtttatttctatatactctgaaggtggagtccctttgggataaataggctagtgtatctcatatcaagagatgatatgacttcagtttcttaaaagtctattggcagacaaggtagatgaaactaagattacagcattgctctcatctgtgacataagatttgaattgctgacaaatatatgtaaatatttaggggacatttcaagaacaatactaaaataatctagagcagtgaatgcacattcatggaagagttgacactaatggtacattctctttttggtaaaaccaggaagtaaaaagacccttctttatgtatgtatgtatatctatctgtgcatttacttatttatttttgagacagggtctcattctcatttccatcatgcaggctgcagtgcagtggtatgatcatggctcactgcagcctcaatttcccaggctcatgtgattctctcacgtcagcctcccaagtacctgggactacaggtgtgcaccagcatgcttggctaatttttttgtattttttgtagagacagggttataccatgttacccaggctgatcttgaactcctgggctcaagaaatcctcctgactcagcctccctaactgttgggattatgggcatgagccactgcacccagccaagacccttcttttagatttttcactaacgaagtggttcatttggaaactcttagagcgaaaaggctagaatactacagtttctgttaatgtttttcttcctatattcctgtcatattaaccaatttctctttaaatctgcttggtggaaactgtgaaaaactgggaagttgaagtttgacttacttttcccttgctttctccacctaactctttttttctccccaagaatgtcatattccaatgatcccaaaccctagagagctctcctgacccttgaagcattgtctagtctcccattcccatgagaaaatgctgccatgttctttcatgcatgggagagaaactgtatcacttttttttgcaggatgtgagatgccagtagtaagtaccctaagttgcttgggcagtgatgtgagaggtacttccggacaggttccagttagatttataaccctaaattttattttcaaaatcctaatcaggccgatcaaaggaagagtagatatttggaaatgcacatctttgaagtgtgattttctcactttaaaccatgtaagctggcacctagagttggccctgtataacaatatagtcaagttatatattagtgatgctagagcggagtcatagcagagaaaaccagaggatagcacccaacagactatttgtagcctgataaactgagtcttcagcattattggaagaaactaataaggctacattgaccctgttgactgaagaaacacactgactctcttttttctgttttgagatggggtctcagtctgttgcccaggctggagtgcagtggcatgatcatagttcattgtgcagccttgactgtccggctcaagcaatcctcttacctcagcgtccagaatatctgggaccacagcgacatgccaccacgcctagctaattttttaaattatttgtagagatgaggtctccctatgtggcccaggcttctatatttttgataacacttttaccacatgcatcagccttcaggagagcaaatataagtaaaatcctgaataagtgtacctctgtaaattttatggttccactagcttgaaaattcctgggcaggtgtgtagatgaattttgtggctagcatttttgttgctttcttgcttgggtaggtaaagaatgaagacctcttttttaccaatacctagtcagggttaaaaatttggtagccttcatgccaaaagtgagcttcatgtcacacagtaagtgaagccatactaataatataaaagtaggatttggcatgactaatcctcagaaaatatctatctgtggataattcagcattattgaatagaaaacttagacaaaaaattatttatggtctccaggttgaaataccagtttcctacattagtaaggagcctgttttttaatgaacaaagtaacgtgcatactaatgtggctcatggtgttgccataatcaaatgtccctttttggttcaaaaactatcatttaatagaagtttgaaggcaagccaagtacaatataaatagaccaagtgggtacaaaaacctgttcagtacttggaaaaggtatgtaacatctgttcaaagtagaaagcactggttcactggcttaattggaggtgtcctagaagctatttttttttcttctgctttagctgttgatctggttttcctctcaggttgttgtaattaaggaatgcatacttcgtatgaatttgatgcagatgaggccaagaacatttttgtaagatatggatcattttcttttatgccaaaagaggaaattctatagtgtttctaatataatcagttagtctctagaaattattctcagatacagtaataaattactttgtgaagcattcatttgtgcctgcaagttaacagtaccattcttcccataaaagggctattataatctaaacttgttggaaaccaagacaaattatgtaaaaatgacacaagatatttaaaaacctatcatgggatgaacaatggacatatatcatagcaagacatatatttaattgattcacttttagaaatagtttatattgatattctgttcttcacatttgcacctcagaagaaaacatattcaaatgaagaagaaaaatatacgttaagcctctaatttgctaacacactaggagaataataaaagcctctatgattacatcatagagtagatattagttcaaggctaacagcacatctttatgtccaatctctagcaacaccaaatgaaaccttccagctgaacctgcaagatcacgcttcacaatacaagtacccaagaaaaatatcttctggactcatgtgcttagctgtggagtaagaaattctactacttcagatactgctgggtggatgaattctccttctctattatctgtacttcagagtcagacttgaaagggaactagggaaacttgcctcagttaaaacttaactatttctggggtaagaatttggctttagggaaagcaattcactgtttgacatgagtgcgatgaaatgacattgaatttttaataagaattactattgctattttattaatatttgagaattacatctcagaaatttttcttacttatttttccaattatgtaagtctgtatgaaacagctgtgtattccttaacaattcttaactcatagataaaaagttattccaaaggactattgactccacgaaacaatagatttttagaaaagtatacatctttgactataaaagagcatgtgatttaagaagtttgttttttgtatgcacatgtgatatacgtacacagaaattactcttttcccttatgtttctaggcctttattctgaaaactggagatttctgtgaaatcaaaaatctttgttctcttattcagtctcattccttactttattcagctaccaccaagcagttgaaatagaattatggaatcagcttctaggtgaaacagtttcacaccttctgatcaaagagtcttccagaaaaattggtcaagtaaagaatggttacataggcaaatgaaaagtagcgaagtaaatggagttctgcttgtgtccaatgactagcaggaagagccccaattttagtgttttaattatttgctaatgaataaacatggaaaaatagttaaaatgattttttaatgataaaaaggctcagtaattattaaacaacaatctgtccgtgaatctgtaaattagatgcatttttgtggctaatgctgacaggttttctttcagatacttgggttgtttctcgccgttctgccatgtgttgtgtgtgtataaacctagttatttccataacaaaggccactttttacctgtaggcttcaaaacacaccaaagatgtttaggaacagttggattttttcttttttttaagtttttgaaacttgcacatttcttttcaataacttgtaaaggttcatgctgtagaaatttaacatttcctgggtcttttccaatgcctgcttagtcattccccagtctccagcccaagggaatgttaagtgtgaaatatctcatattctgctcacctcctacccctgacaacaattactgaatacagaatttctatagcctctgcctcttgtttgaagttgtgactcttgattcaacttttctcccacacttgaatgccaacattatagaccctgccatttctttgtgtagcatttctgtgcaatgccccaacacccatgaaattatgatataatattgtgtgcatggacatctaggaagcactagtccagatttttacacagtatgatactataaagatattgctttggagtttccagaaaaaaatcatctgtgtaagtgtgaattaaaagcaatgttgaataaatataacctgcacattccattataacttaattttaaaagtgaaaactgaattgtgactaaagtgaagataagacacactctttctcttaaaaccaatgtttagattcatgggttgggaaatagaagtgaaatgaatagcacaaatattattaactccaatcaccgtgaaagaagcattagaatttcctattttgcaaagctagggctatcatcctatctaatgaaagtagaggaagaaataaaagctaaaacacctttgaaaatccatggcttatgggtgtgtaggctgcagaagtagcaactaaaatgtaaattgatagcattttttaaccaaggtttcacatcttggttttcataaggtttactggtttataaagataaataaattattagcatagaaagctgctatttcacaatagtaggtggtggttgggaggtatcttaagttgacattgatctcaatctcctgaacattttttctttgccttcaccaaaaaaacagatatttaaaatggaaaaaaaaaacaattaaatctaattccaataatttcagttggaaaaaagaagtagtggggtagctagtggatttgctttattttatgttactcactcatgatcaaatgtatgtaataaatggtaatttggtgttacattggcattaactattgcttcctgcactgatgattttgccaagtgctaatcaatatactgattttttttgataagccatcaataggtttatttcttgtaataaagtatttcattagaaaatttgatatactattcttgggtattagataaatactatacctacttttattactccttgctgtatatactagcaaaatgtgtgaattcatgaagattttgactatttatgtaaatataattatatttataaaattgttagagtgctagtaaatgcatccagtgaaacagacacagaatgtattttcaatctcattaattaattagaatacagaatttctctgtggaagtccccaaatcatgcaaactgtgtttaattacttcagtactgaaagattgagatgaaagatgaaaagaaatggactatagaacaatacgttttacagatttagggttattatccttcattgtcaaaatagatatctgctgaattaataaaaatataaatatttaatagaaaatttgttgtttatcaggatcaaagttagattatacaggatacagataaacaatcttagatacatgacctacctactaagaacctaaaaatctaaatgggatacaagtttacatgcctgaaacaataaacagacaaaagtgatgatatactcactagtaacaagatgaatatggaatcatataataaagtcctaagtagacttccgatgaggaagctatcaacttcagagtcccacaatcatatgtatgtgtcttggatttgttttttttaactcactgtacggtcttcgacaaatcactttacttgtatgaatgactgtttcttcctctataaaatagagttgatttcatctatcttgtatgtatgagaatattgaaaaaatgatggaaaacacacttctagtcatgtgcagtgtgtttgataacatatctcattattaactgtgaaaaaaactggagaaaacatcatattgtgtcctcagaaaatacaaaagaaaaggagggacattgaaggtaatttctgaaactattgataatcaaagagtgggtggaaatggggaggggatgcaaataagaatgttgtattcttatttggggatgcaaataagaatgtctgactcatctttggagctcacattaccataatacatatagtggttgttgaatgaataatacaattaaatgaatcaagaacataatggggagtttggttgactacaaaagtttaatcttttgtaaccaaacaatattgctcttgccttagaagatctgagctcttgaaaaaagaggtgaagggccaggcgcagtggctcatgcctgtgatttcaacattttgagaggccaaggcaggcagatcacttgaggtcaggagtttgagaccagcctgaccaacatggtgaaaccacgtctctactaaaaaactacaaaaattagctgggctttgtggcatgcatctataatccaagctacttgggaggcaggagaatggtgtaaacccgggaggcggagcttgcagtgagccgggattgcgccactgcactccagactggacgacagagcaagattccatctcagaaaataaataaataaataaataaataaataaataaataaataaatatataagtcatgtatgcattataagaaaatgtataatcactttataagaatgttatctcatataatacaataaggttttaaaataatgtgaagaatcgagaaaattagtgattgatgggagtggaaaattaaaaataaaaaaatttaaaagtcaggagtcaataccaggagaattaataatctacagtcacttcaggataaattagaatctatatttacttcattatgtaatatcattaataatagctacatttatgtataaacctagagagtcgtatgaatttggaaagaactgtcatggatggttaagcagagatggaacctgtagcaagctctctgtattgtgagtgaagcttgactcattgttgactgtattcattgtagaactctccaccttacaggtgtcgcatgctatttcttcacaagtaccatttgatcttcaccctttatttgaaaaaaaagaaaaattagcctatgcaatactaggaaaccattaaccttgcaatattgccagttctccccaaacattcttctcttgaaatatggtgcattttcccccttgatgcccagtgaattttaattttctataacatgcaagatgtataggaagaaaattcttctgtaacattgacagtatgggacacgttaaagccaagtggcctttatattttcatttttgggtaatgccagttgtgtcatcaccacagttagaatctttacgattactttgaggaagttcttcattccactgctcctttagatggccagggttcttctgctgtagcttggcaggttttcctacctttgaaaaaggaacctgattcaacagcctctctacctacttttatggttcttcactctcttgaaagaatccattgatattcttgcttcgaactggcagaatttttttcagttggagacccttctaagcaaaaattcacaaagaggtatatggctttatttgtgagttcttaagaaaattatgtgaaaattctgtcactttaacataaacagtattcagcaaacattcagaagaaagaagttaaaaatagaattaatatagatttaaacatgcacattatccagcatataacacctgtatcgtaaccttttgtagctattaatagttttcatgctcaaagttattcaggaaatagttgagccctttagtgtcattttatttcttggtttatgctatagcgattttaacacatataaaacaatataacaaacatttaaaaataggctgcgttcggtggctcacgcctggaatcccagcactttgggaggccatggtgagtggatcacttgaggtcaggaggttgagaccagcctggccaacatggtgaaacccggtctccaataaaaaataaatagataaataaataaataaataaataaatataatatacagaactgtaaagacagagaaaaatgaggggaggaggtatgctacatgcataacaggaaggttggtatcagaaatctcgaatggcctactgcatgccatgtagccatgatgttttgtattttcttattttgattttactttcatcttaaacaaaaagcactttccatgataggtcttatttgaatcactattactctgcttaattctaatacaataatacacaaaatatgtaggctagatttccttgcttgagaaaaatgctgtagtgaaggatttcactcctaagtctgtttatgattcatctactgaatggttataagttaataagtggaatgaaggataggattgtttgttttctttttcacctacagaatattttgtttcaagagatggacaatacagattgcacctaagagcctgtaggcaagccatctgagaaagttttctgcatgcagccatcgtaggatctatattgcagacaagatatagaattatatgctcaattacgaatgggtcagctgtcccaagtgtctgatgtgatggttgtttgaaagggtgccttgcacatttggccatgacttgcatcagaattcttattaaaaactaagtaatacaactgaggctcaatccatggcacagcccagccctcaaaaccaatattcatgagtaagtaactaaatgactgtgctccaaaagcagagccttatttactggtatgccgtctacacaaaaatattagtattataagttgtccatgagttcattttttccatagtttctctcaagggggtaggattgttgttttatcatcaatttccaccttcagaaacattcaggagttccctcccatcaaacaaacaaaaacaatggcattaaattcattaaacagttgtttagtttctacaatgtccaaaatataagttcttatgatagaaaaaatattcacaagtacatcagtaactctggacatgatgcccctcgggcaccagacctcatctgtgagcaaggtttagtttctgaaagattccccttctctctcatcggtagccttccaaaggattcctataccagaaatagaagtcaaattttcatgcatttattgacttttaggatttccaagttagagatggaattttacttcttgattgctgaaattcttctacaatcttaatacagcaaaatttagaaatattacatattaaatgtttcactacattcaacactctctgataagtagccacctatatttgtctctcttacttaaagtgtgtgatctactagtagacatgctagaccaactaactctcaacttacttttctcaaggcaatgttattgtaaaagatctttaaaaaaatctgtatttgcttgctacttgatttcatctgaatcccctggtcttcttgctctcaaccatttatgttcttaacgctttctcagaagaaagaattcaaatgcaaagagaaacagaagataatcacttctgagttaatgttttccttgaagttcaaatccatggatataattttattgctcccttaggatttctatagattttcttcctacgggtaggctttttttaaggtaagctatttttgacaatgctatagttaagagactagaatgcaaaggtggtataattttcttaagttaagtgaattagctttcttctttaactccatatttgaacctaagccttctagaaattatagaagaacatattatatcctaaactaaattgtaataagacttgccttagtaaaatgaaaatactttctggagtctgtgtgtaatttacatacaatgatatcagcaatcaaatgataagaaaaaaataagtatatcttttcattataaaaaaaagcatccaaacactttaataaagtatttcttaaaagatagataattttgatttataggaagatccacccccagatgtccatgacttgtaattttaataccttattaattgtagctttctatattttagggaaaacattcagatgcaacattgtgttggaatagaagaagtttattccataaaaatattaagtgtctactttccttaggatattgctaaacagtatgaagactaagtgatctacgccacagcttcaaaattaaaaagacttgaatgagattaatatcaggtttacttagttgacacccatctaaacatttagtatgagtctctgtaaccttaacaataaaattagggttttggatacagtgatttctactggtgttttcaaagaaaaagtcctattattctataatcttatgatttggtcaaaagcttgtgaccttgagatgcttttaaatatatttattgatttagtataaatcagaaaatacattcatttctaatccatcttagacaggtaggagagttatatttaagtttcctctgggtgtgagaaggaaaatgagtcatcatataggtttctaactatcctgtatgcatttcttcactaatatgtaagttataaccagttttaacactcaaaagaaatttattgttgcattatacaaagatacttaaaaaaaaaatctcacctgtacttaataatttgtcttttgttgaagctaattgataatgatatcagttaagtccttagctacctatgcttttataatattttatttatttatttattttacctaaagcctgctctaagttctgttctttttcaatcagaagtaaaagagtatagaaaatattagtggcaggacaatgtttgctgaatcaaaagtcatacctaggtaaatgcctcttgagaagatggcgggaaggagctctcttattcagactctgaaatttcaataagtagctgagttccgaagtgtttatttgaacagaatgtttaaaaaacataaaatttcccctttacaaccaactctccagatacctagcatgttgatatttagattctaaaatttatatcaaaaaacatcattgaaacagatgctggtaatatcattgactgagaatttgcattaaagatgactcttgggtgtgcactcaagcgttcatatgtccattaatagctacttgtggggatattatgacctgtttagaattcttattttttctcaaagtttttaaggcataagagaagattaatagctgctagatgaaaccaaaaggataagcagcaatgcagtgaagagtgttgtgaaatacacacatttgtcatgactcccaagtggcaaataaaatcaaagttgaaaatcaatgtctattgatcaatctattcgttttcatgcaagttctataaactatgtagtactgatgttagtattttattggcatatagaacagacataaactttccttttctcttgagtctttctgctcataaagaatttaaaataatagcatgacatacataaagtaagatttgttcttaggtttcggggaagagcttataaaacatgcatacattatgataaacaaaatggaaggtacactgcaagcaaaaaataaccacatttaattgtttttcagtctggcttttgatatcaggctcaaaatttgcttgcaaatttaaagacattattctgttttgggaggtatatagttatgaaacttgttctttcaattatagtcacaatataaaattactggatatgaatcttgaggcaatcccaggtgactggatattgtgttgacaatgaaaacatattaataaatgttgacttacgcttataaagagcttactgaaaaaaatcaagcaaatttgtgcatggcttttttggattaatgtgatagtagaaagaggttatggtatatacacataagcagcttaacagatagaattagcaagctgggtattgccaatacaaaatttgtagttcaaatagaatttcagaatgttccaaaactgtcctaatatctactatttcaatgattagaaattagaatacctttcattcctgaaaaatacgtatttacaaaatcaaaatgtcagagtcacaggagatataagctatttccttattaagaaaagtttaaataataaaaagttaagtcagtagaacaatgactaaaataggaaaagtacaaacaaaaattgttagatgcacctgtgacaatattgtctagttactgcttttacagccttagcacatattttttcttaagcaattcctgggtagagttttctacctctccttaaccagccagttcacatcagaagacataaaccccttggtggatgttattcatctctctgtctcttgctctgagctgcgtattgcacagtaggcattcagtaagcctcatcgagctcgtcttctcatgggacatgcagaaaacttgtagacaaatgagaggagagtaactttgaagattgtgatacatgttatgaagagaataaactgagtgaagagataacatactttggataagctagtcagaggcggcctctccaatgccatgagtagaatgggacacttgtgaagagtcatgagggaaacatttatggcagggggagcatctggtacaaagtcctggaggaaaaggatttggcatgttagagggacagagaggggccagaagagaaggtctagaacaactccagagtgtagggcagagacaagaagaccccggtaaggactccatatgttttactaagttccggggggtacaaataaaagcttctaaacaaggaagtgaaaatgtcttgtttctatttaaagattgccctggctcatctttagaaaatggattagatgtcgggagatgaaaaagtgggaaaaatgaagaataactggctattacctctttgttcttcaaaattgttctcatttttgaatactttcttacatataagtacaacctaccccctttcctctttaaattcttatccattatctctctttccgcatgtatttaaattgtgctccttccttcatttttatgtcattcacctcttttgctttctcccacattttatttttaacttgtcgatgttaataatcatttttaacaaaaatttcacgtctactccaaataccacctacttgcacctggcagggttgagaagcttactctagaacagaaaatatgaattataggttgtaagggaagaaacatctgcactgagcatggttagggttaacttttgcctgccttaccagtagtaatatatctaggtcagagcagaggcaacagaatgctgccttaagtcaaataactcacttctttctcttttagatacattgggtgaaggacttgaatgttttcaccacttgtattcacaacagagtgctgacaggaaacaacacacaaagagtgaactgactatagggagatgaatggctgcttaactcactgcctagtccctcagtcctgtctacaaaggactgaaagctggcatgacaaagactaatagtagattcaggatgaatctcctctggtccacatgacccaggttcagttcaatctgggaaacaggggtggaggaaaaaatgtattattcaatcaactcaccctcacctccactagcagcctaatatgtactggagtttgagtgacgcaccagagccctatcaactgaaaagcctgaaactagaggaagtctcacaaatgtcaatggttattaatttcagttaactgattaattctcattttattagtgatggacttggagggttctaataactgactcttgaagaattttcatataaatgttattatatattttcacatagcacctttttcttcccatttctcacttaggtacaaggtttcactatttcatttatgtaatagtgagatggggggaatactgtaatatcttttatacaccacagcaacaaagacataacattttgttctgtttcatttatgaaggatttagaaagaaaatgatctttaaaagaaaattcaatttttggaaaaaaaaaatgacagtgaatggcacagagcctctttatttcccttgaagctgtcagagtcagagaagaaaaccactttggggtatgagtctgcggtacctgtcataagactgaaaggacttgatgttgagattttattagctctgacaatatgggaaaattccattctaaactgtaataagtagtatataaagtaatttagatatgccagtggctatggccctgggtgtaaatgtatataccatgtgcgtaaataaagctggggtaaatttgccactaatgaaacttctgtgtaatttaggcttttttgaaattatatgaagttttgaaatgtgtgtgtgcttgcatgtgtgtgtgttttaatattaacactctgcaaatacattatctcccttttaataaataaaatttgaaatatatgtgtgttactacatgcatatctatagactataaaataaatggatacaaaacttgcccttaacaatttatgctgtttaagctaatattatattaacgcaataatattatgatatttttcctctctctttgaacatagcaaacattttctcttccatcaatgactgtttccctttggttgtttttgcaatgatgaaataaaatatcaacacatttcctgaaaaataggcaatatctcaataaaatttactgttagcaaatgatgcccagctttgtatttggcatttgtcccatatgagaaaaaagtcaattgcagaataatatggacagtcttttcaacagtatgacagactcgcaagccatatatatatacacacacacacacacacacacacagacatacacacacactcactgagttgacatgacaataaaaaaagtattcagagtgcgtccaaaaaggaattgagaacaagaatctagaaaagtgacccaaagagtcctggcagccggtttctctgctaatcccacatgaacttgagttttttattctgatggccttggggaaagcaggagagagtgcacagaggccaggctctgcccagcattgtaggggagcccactaccaaaggactgtgtcatcagtttacctttaagatacattaagaaaacaacaaaccttacatagcaataacaagcaaatgtatcttttttacctgggctctttcttgagtggtccccaagtactcactttagaaatttatatttgtgttcttggtttctagaatgtccaggctaggggaagaaataaatacaaatcctctctgaagctaagcaacaacaattcaggcctcaaagattttcacagataaacttttttgattatgcttaacaattttttaaaaatcacaaaacctgagaggggaaaaaagcgtaatgtataaaagagggtgaaggtgaggggcagaaagtagattgaggtggaaagtattgcagatattgaaattctcagattcaaattacagaataagtagatgaatgcacctactagaataaaaagtgtcaaaagcaagactaagtaaaaatatattataaaaatgacagcagagaaaaaatataataattaatgaatcacacaatgagtaagttaagtagttgatatgaaattggtgaagaaagacagtaaatgaaatagaaattttatataaaatgattctgaaagaagtgtggagggataaaatggtagaatgcgtaaaagagaggctaagagatacataaggcaacctagttgtaaaaagattttaaaaaggaggtttgggcggggacaatattaaaagagataagtgatgaaagatgtaaattccacccattcaaaataaatctccagttggaaaaattaaatgccatccagtagaaccatcagagttgcaaaacagagtaccaaagatctgagaatagccctggcgagaaaataggtattctttgcaaagaaacaatagttagactgagagctgattcctcattactaaaaatagaatctagaattgattggaatattgtctttgtcataacttaataacagtcaacttagaattgtatacttgtcaaaaatatcattgaagcataaattcaagataaaggcattttaataacagatcaaagaaacaagagaaattcactcaaaaatgataaggaatgtacttagggtaatagggaagggaaggtctgaatcataacaaggaagagagagcaaaaaattagttaacgtaggttaaaaaagagaaaacatcaaccttataaatcaacaataggatgaagtttgtggagttaataaagaactgaaatactggacacagataggtgggtgagcaaagtaaaatcttttcttttcttttttttttttttttgagatgaagtcttgctctgttgcccagactggagtgcagtggctcgatcttggctcactgcaacctctgcccccaggttcaagcgattctcctgcctcagcctcccgagtagctgggactacaggcgggcaccaccacgccaggctaatttttgtatttttagtagagaaggggtttcaccatgtcagccaggctggtctcgatcccctgaccttgtgatccgcccgcctcggcctcccagagtgctgggattacatgtgtgagccacaacgcccagccagtaaaatcattttaaggagaagacaatacacaaattattttagacttgctgagatgattacctatgttattatttctaagacgcacattaaattatggaatgggtgtacagaatttaaaactgatagagagaatgaaatgtaaaaaaggaagaaaaatataaaatacatcaagaaaaaagaaacagagaagtaacctagaaaaagcaggacacatggaaagtataaaattaagttatagaaacatatccaagtgtatcagtctatttaataaatgtaccaggaataaacacactatttgaaggaacagattgtcatattagacttaaaaacattccaggtgtgtgttgtatatgacagatacaattaaacatgagaaatagaaaggttgaaagaaaaaggaagaaaagaagttgctaaaaaaataacagaagaaagaattattttctaaatattaatatttggcaaatagacattggggcaaaaagtattactagagaggataaaattgactccataataatataactttaaacaagctagaaatatgtaagtattataatgcttataaatattgtaatgtttgtatgttatgcaatgtacatgataaaatgttttcaattatgctatatcaccttttacttaactgcaaggagaaattaatgaatgcaacaaaaatgggagattttagcaaatagttctcagcaagtaagagattataaaaatcacgagtaaaaatttaaaatactaaaaaatattaacacttttatatattggacataagtaaaacattgtgcactcacatacacacaacagataatatataattaagcacttttaaaaattacttgtgctacacaatggatactaatttcaaaatgtcaaatagataatatctttcagaacacattcaatttttaaaaactggaattaagtaagaaatctgcggaaaaaattgctggaaaatatttaaaacacttttgaattactacggaatcaagaaattacgctaaattatacacttctactaatagtatagaactttaataacatatcaaaacttgagggataaagctatagcaataatttagaagctagtttgtaacctgaactcttacagaaataagtagcacattattgagcaatgtatcccagagttacatgcccaataaactagtaaaatattttaaaaatgaaagtttggaaagaaataatgagtataaagtcagcaattaatgaaatagaatacaaagtgtaatagagtaacaaaaaaaccattctttgaaataaagtaactaatttaaagagtttgcaaaattgatcaagtaaaagtattggaatggagataaactagtgcagatggtgcagggatattaatggagataaatatatttgaaaacacatatgtcaataaatttaaaggcaattgaccaggctttgtttatggaagtatatcactgattaaaacggagtcaaaaagagattgaaaatagaaacggccccataagcataaagtacatggaattgtgaatccaaaattttcctaaagcactgttttgaaaatttcactaaatattcaagcaacaagtacttctccttcttattcaaatggttttaaaaaatagaaaatttcaatatatacaatatgagaaaaaaattataaaccaatctcaactattaaattaaatgcaaaagcctatatatattgatgtttctgaatttagtgatgtgtaaaaatttcaatgacttattatcaagttcaattttttagggatgctgtttaacatttgaaatcatttaataaattcaaattgaagtagcaaaattacatgatcatttcaatggaaagaaaaaacatttgataaaatttaaaatctcttatgataatagcttttagcaaactaaaaatataactgtaattctaacataggagagctacactaaatctatggtgaatgcctgatctaatgagtaaaaataaggatcatttcttttgtaatcatgatatgcactataatcacttttttcaaaatcctgtacctttgggttatagtgatttaattagctttagaaagtaataaatatataaaccttgaaaagaaaggaaaagagcttgaaattattcatcaataatgagaaaaatctaaaaattaaatgctagaattaataacatcatttagcaagttagctattttaaatcacagcatcaaaaagaaaatatatttttagaaagttagcatttacaatgaaaattaaacacaagataactaggggccaaattattcaaagaggcgtaaggacataatgttgaaaagtatactttactgaaaggcaatgaaaaaaagggctaaaaaattatggatagtgaaacagcatagtcggttaccccaaattaatcataaattcaatagaattctaatcaaaattaaaatggtgtgcgcatgcgcacgtgtgtgtgtgtgtgtgtgtgtgtgtgtgtgtgtgtgtgtaagaaaaaagagtcaggaagagccaagatacagaaggaaaattagcagcagtataaagacttgaatgacagatattaagacttactactttcagtccacatgctattggatctggagtagaaaaacagatcaatacaacaatcagctaagaaacagaaccccttatgtgttgaaaattcattgatcagaattggcattgcaaataggtgaaaaagagatgaaacattcaataagtgatcttggattttaattatcaatatggaagtttatttttaccttatagcatatattaaaactccttaaagaaaattacagacctaaatacaagacattcaatctttaggagaaattcactttagttttggaaagaatctcctagaaatagaatttgcagctttacattaaaattgagtataattgtatgaaaaagcaacatacatggaggacaaatacaagccaatgacacaaataactgctaaataatgaatatcaagagtatatatttttatattccacagataattgagaaatagcccaagagacagtaaaggcatggggatttatttttaagaaaatcaaacagaaatagacaataaacataagaagaatacctcattaacaattggtgaggaatacattttaaaagtcattacaatggaaaaatttaaacaaatcttattatgggtttctggtatacatattaactggcataacaatgttcaagaaatgatcactgtctagtaaggttgatgtgcaaaccttatggaccagaaaatctactcacaaatataatgtgaggagtggttttcaaacttcatttgattgaagcacatacgctaaaaaaataagaaaaatgtaattaaaatttatgtagccttattttgtgaatggcactctgtcattttgtattctatcaattatgtttaaaaattctattcataactcattgggttgatttcatgccaatgaagagttgtgatttatgatttgaaatacactgctccagagcaattcttgcactatgtaatagaaaaagtccaatagaagtttcaaaaaaacatttttgtagcatataaaaacacataatcatgatgcctacttataagaaaatgaggactagcttgtgttgtatagttatacaatgaacaattatgtagcaataaaagtaaattaaatttagttcacaaaagtcatcttcaacaaatactgcaaattacgtaagaatacagatgcttctgattcatgcaaagttaaaatatgcaaaattaagaaatacacaagggagaagtggggaagagattatagataagtacatacatatttgtgaaacaatatttctaaatattcattaaaataatctgaataagtattgggaaattagacaatcaattaaacattattttagaagttgatatggtttggatttgggtccctgcccaaatctcttgtcgaattgtaatccccaatgttggtggaggggcatggtgagaggtgattaaatcatgggtgtgaacttccccctctcttctctcttgacagtgagtgagttctcacaagacctggttgtttaaaagtgtgcagcactttccagttgtctctcttcctcctgctctggccatgtaaggagtgcctgcttcccttttgccttctactatggttgtaagtttactgaggcctccccagccctgcttcctgtaaagcctgctgaactgtgagccagttaaacctctttttaaaaataaattgcccagtctcaggtatttctttacagcagtgtgagaatgaactaatacagaagtcttaaaatatctgattacttaatgatgtaaacaactgaatataaagtaaattgacagtcaatgtaaggctgaggacctcttgtgtaaaagaaatagttcacaatttgagtgattttcttttatttacattgcaagaaacaaaaacaaaaataaagcatacaaaagaaactttctttggtctctaattccaccaccgaagtacaatactgaaattcttagcaaatgctctttaaaaccatttttattcatataatatatatacacctttttatttgtataaaatatataatacgaatgaaatatatctatctatctatctatatatatatatgtttacacacacacatacagttgacccccgatattcatgaaagattggctccaggactcccctgccctctcatgcatgccaaaatctaaggatgctgaagttcccaaaataaaaggtatattgtttgcatataacctatgcacatcttcctgtatactttaaatcatctctagattacttaaaatacctaatgcgatgtaaattctatgtaaatcgttgttatactgtatcgttcagagaataatgacaagaaaaaaatgttggtacatgtttagtacagatgcaaattttttaaaatatatttttatcaataataggttgaatctccacatgcagaactcagatctacaaaaggctgtgtgtgtatacgtgtgtgtatatatatatataaatggcagcatgttacatatatataacatgttaccattaaactgttaaattcaacatactcttaacttgctttcccccaaaaagacattgaagcttttccttatgcaattagttaaaagtacatattttgttttattagctgcaaagtattatagtttttggtataaaacagtatttatgttctttttaataaatatttgttacttactaatttgtgtgtgtgtgtgtgggacagggcctcattctgtcacctgtcacccaggctgaagtacagtggtgcaattatggctcactgcagcctgaaactctggggctcaagtgatcctcccgccacagtctccagagtagcgggactacaggcatgcgccaccacacctggctaatttattctgtattttttgtagagacagcattttactatgttgcccaggattgtcttgaacggcgaggctaaaccaatctgcccactctcaaccttccaaagtgcagggattacaggtgtgatccactgtacccagccatttattagtacttcaaaattatttttaaatgatatagtatactccctagacatatatctttgtggaattacccaattatttcctaaggataaattcctagaattatttaaataaataagaggaacttctttgtatatgacagggttgataaaaaccatccttgtacacatctttatcaagatcaagtacaatcaattgtgttgctgccaatacgtttagcaaaactcatttttggctttttaaattttcatttttgatcactaatgataatttcatatttcttcttttgtgaattgtttatgttaatattcacctttcatacaaatattcattgttttattatcatttttaaaattaaattctttatcagttgcaaaactattacaacataaataaatatgcattgactttattgttgtttctctcaaatgccaaactttctactttagaccctttgcttttttcattctcttcttctggaatgcatctctcctattcctttgcgtgactcattctcttactttatgtagctctctgttcaaatattaccacttcacccactctcatttctcatcagagagccagccttccgagttgtagaaactgcctactctgaaatctcacatcctgccttgctgtttagcagtcactctgacctaactatccttacctttcttaggtcttcaaatacagtgggcatcgtcccagctcaggacttaaggtcttgccacatgatggcctcactgcggggaatgttctttctactttgtagtgtacctaaatcctgcacatccttcaggtctgttaaaagtagttttctcaggaaggccatctctgactttactgaacagacaaggtctaacctctaatttctgtagatttatggcttagtgtagtgacagatatgtaggaactttataaacgttaattaaatcatgttaaattaataacatgaatgaatagcaaaatatgctgctgcttttacaatgtgggttattccctaagcaattgtcaaaaaataagttgctataaaagcatatatttataattgtagttttatagtccacactgggaagctttaaaacccaaggaaacattactcactttggtccctggtaaaggctgcgctctgtgttttagaaactaaaatttatggacagccaaccttgctgctgacatctatgaaaaaggaagaaacagaaatatgaggagatggtgtcaccttcattaaatgcgtggaggaacagtatttacttttccagttttcacaactctgaccagaaaactgttgtctagttatcaacgcattgcggcattttaagaatatattaattaggaattctaactctttaatttatcttaacctctgtctaccttagtcttgcccttcattagctaacactgaaatgacctatctgactcataagaagtcaacaggtaaagagcaggtgtacaatccattctctccctttagaatagggaatgtctttgggaagaaagtaagtaactgacctgttcagatgtcctcgtgagtatgctaacatatttgacaaaaaaaatggtattttctagcgggaatcctaacctaaggtatccattttgctggatgcacttaggttgaattgcttgtgataactggggatcaatggacaaaagacagcataaataatgaacctgcatgtaaaacgtttatgttttatgatcagaaaagcacctttgtgtaagtaatatggcctcacatgttaatctagagcacattctaatgcagtaagaatgaaaatgtacatatacgttagacagtttgaaacctctcactgctttacctcttcctagtgattactgatatccttgaaattattggtaataattgaacttcactaaaatctctgatacacccaagtctgatttgaaaatataatcttttgtgtgatatccacagatattgaaggctgattgtaagaatgcaacaaaatatcatccataaaaccatgacttaatgcataaacagctgaacaaatacacaagtctttttctatattaaaactatggaagatatcacatgaaaactaagctaatgctttcagggtggacggaatatgcattgaaggaaaatgtttacaaatgggaaaatttttgtttttttaacatgtatcaataagtatattttaaaaattaggaaagagagtcatttctatgagaagaagttcacaaaatattgaaaataatcatattaggtctttactgttatcagataaatgaattttgtacaatttcaatggtcacaattcactgtcaatgttaaatataaatacttttttaactgaatatcctagatatttacaaactttacattactcccatatcaactatgatcaatcacataattgcaattaatcttcctctttgtgattgaaaaataaattctgaaaacagatgtgaaaaatgtaatgcattgataaacatcagttttctacagtcattacatagcccattatttatatttctttgactcaaatatatgttgtgattttatattcagtttttaaaagaaaatctattatctttaacattttaataaatgtacaccatgcttgttaaatgaaatgtcaaaaagtatcttataataaaatattttttctttattagagaaacttgtaatctttcttccatccataccttctgaaataaacttaaaggaaatgaatattgtaaaacatgctttagcctgagaaatatgcaataattaggctgaacctagaattctgtgttcaacttagtaagtaaaactttttatatttgtagtaaggaagaactttatagttgacggcttgttacgtttaaccaattagaaagactatcacattgtaccattacaaaatatgtaattctaagggaactagagtctgaaatgcaggaatttttttttgaaaacaatataatgcagttgagaaattgttgccttatgaatgtaaacatttttgtgaattaatcattaggcaatgttctcttaggtaagatactaagtctgagccatggaatttaaaagatctcatcatcttagaaatttatcagccgatagagctattacaatttgggcaactttaaaatagagttctgtagaataattctaatatttgttaaattgtttagtgttccattagagttataccaattttagtgaatataacttctctgcagaataaatatttttaggggcgctggggtgtcttcttttagaatttgtatatacatacttactcagagctgagcatagtggcacatgtctgtggtcccagctactcaggaggctgaggcaggagaaatccttgaacccaggtgttccagaccatcctgggcaacacagggagaccctatgtaaagaaagagaaatctgtttatgagaatgactggatcctatagagcaattggcaatgtgagctcaaaatatctgcctgacaaaagcagttgttctacgtgatgataccagcatttaagtggaaatgagtgacatgtttgcctgaagcaaatagaaataatctccctttatccacactcaacaatgaaaaaaccaaaggccattttagaagaccttcatatttcatattttttagtcagagcttaaaaagaatagaaagcaagtaaagcaaccacaaaataaacttatttattttccaatggagaacatatctgaacaatttagttgtctaatcacttcttactctactcattataggtttaactaaaaagtgaggacagattatcactgtgtatgcaaagggaaactacaggtacagattgtaggtgtctttcttcagctgtcatagctttctaatctatagcttctgtttattgaatttggctactctttacagcactgcctctaacatcagggacacaatattagagtcaaattttaccaaaacaaattaatgagggatatggtgagttaaaataggacagcttttctttttttctcttattttttttggagatggagtcttactctgttgcccaggctagagtgcaatggcatgatctcggctcactgcaacctctgcctcccaggttcaagtgattctcctgtctcagcctcccgagtaacagggttttacaggcacatgccaccatgctcagtgaatttttgtatatgtttaatggagacagggtttcactgtgttccccaggctggtctcgaactcctgatctcaggcaatccacccacctcagcctcccaaagtgctaggattacaggtgtgagccaccacgccctgccaggatagcttttcaatgagcaatttaagtaaatggcttctgttttaaaacaaataaaatgtatatataaatttttttaaaaaaactcagagaaatgactgtctttatttaaaaaaaaaaaaaaaaaaaaaagtcaatgttgtataccagcaggatttttagaaccttactaggaaggtaaataacaagcacctcaggaaaatgtgacaatctggtgttgaactattacaactgatgggagcacctaaggtctagatgcattaagctggtggtgtgaatctagttgctttagtctctttcattgtcactagagaaattattaagagaaacacaaggctactctgcccacagagtagccattctttattcctttattctttcttaataaacttgctttcacattactctgtggactctccccagattctttcttgtgagagatccaagaagccactcttgaggtctgggttgggactcctttccagtaacatcttcctggaaaaccacaaaaggaaaatactgaggatacccctggcacaaaggaaaaagatggtagcaccaattctccaattgtgtcccaaagtctgtttattttaccagggaattgactgaaatggcatactttcttttaataaatcagatttgacttatagagccaacaaaagccccttgggtaaactgtcttcataccttgtctaacagtccctgtacagggttcctgacctgtggaaagtaaagaatatcacattctgacaggcccaggagccacaagttctctcagggcctcaagaggagaagaatttacccaactcataggtatttgatggtacaaacccatggctgagttagactttaaaaaacaaaaaagtcttatttgagattccttctatgggacaaagttccatcaacaccaattaaaaaaaccctacgtagcaaataattattcttgctgcactttatacaaataatcaggccaactataataaagcaaatcagtcttatgatttgtttttagtataaatgggaaactgaagaaataaattatgtttcaaaactatggtacacctgttattagatttcagtttcatcagttgtttttgagttttttctacaatttaggctaacgtgcttattcctgtaaaaccaaccagtggtctctagctgctgctcagaagaaacaagggggatgggtaatgtaaaaatctggatcaatattctaattgtgagcacatattggaaccagctagcaaccctatcagcttggttccaacagttgcccagttcatagaaagccttcttaattagtttactcaggatagatttacttattttgcttcactcttgtggaatatattgctgttgtactctatgtttacaatgaaagataagcttactcaatgtactcttaaatcgaacacttattaatcttccatatataaccttttgtcagaacgcaaaagttatgaggggactttgacatacccatgctttctgactgagttcctctctactgtgaatacaagacaccctaatagttaggcaggaatatcatcgcccctatccaacctgaagaagttacagaagatggatcattatttgtctctaaccctttggattaaaggttcccttgtaaaaggaaggagagaaatatgtcagaagcatttgaacaagatcaactccatcttgaataagggctgggtaaaatgaggctgagacctaccgggctgcattcccaggaggttaggcattcttagtcaccaaatgagataggagatccgcacaagatacaggtcacaaagacatggctgataaaacaggatgcagtaaaacagccagccaaaacccagatggcaatgaaagtgacctctggtcgtcctcattactcattatcgactaattataattcattagcatgctaaaagacactcctaccagcgccatgacagtttacaaatgtcacggcaacattaggaagttaccctatatgtttggtctaaaaaggggaggaacccacagttctgggaattgcccactcctttcctggaaaactcatgaataatccaccccttgtttaccaaataatcaagaaataaccataaaaatagccaaacagcagcccttgtagctgcattgcgtatggagtagccattatttattcctttactttcttaataagcttgcttttacttttttttttttttttttgtgagatgatgtctcgctctgtcgccaggcaagagtgcagtggctcaatctcagctcactacaaccttgaaacctccgggttcaagcgactgtcctgccccagcttctcagatagctgggactataggtgtgcaccaccatgcccagctaatttttgtatttttaatagagacggggtttcactatgttggccaggatggtctcaatctcttgaccttgtgatccgcccaccttggcctcccaaagtgctgggatttctggtgtgagccactgcgcccaacctacttttttttttttttttaaagagaaacataattggtaaatacaatctaagaagtgcatcatttttagtactgtgctctaatttataggatcatagtatagtaaatttgggaaagatgctagaaatcaaaaggagtgaaactctcattttatttgtgccattaatgtttggtatgtccaacggcacagcaaatgatgtagctaggagtacacccaggtcattggactttctgatctgtatatttttcaatgcaatgtaagtttacatatccatatatttatagaaggattatagaaaaaggtctgagcctttctcagttatactttcagagtataaagaaaagctatatagttatttaaagagtggaatttgcttaaagagtggaatttaaagagtgttatttaaagagtggaatatccaaaaagaaattaggtttaaaaagtggtgtgtgaataaggtaaactgtttatgtatataccaatttaactatagggtaatgtcatttttaaactaattatttagttctctatatgaagtagaaagttaaggatatgatttcaattaaccctaaggagtgatggtaacctaaatgtaaatcgcttacttaaacaggatctggtttcatcttgataacccagctttagcaccaatagcattcaaggaaccatattaacataacgacattacaaactaaatacaacagtattgctatacaggaagagagagaataaaaggcctatatgttaggagtgaattatccgtgggtttcttatatttctgcacatcttgagagcagaagcactgaaggccctttttatggactattttattgaagatgttttatagaaaagagtcttggaagatagagatagaatcttgctccagcataataaagataatgtcttcctccaaggcaaaggaaggcaagtttatgcccattatattataaaagaatcaagcttcctcagtgtgggtatcctgtcttgtaatgtaatccattgcatgttctggtgtcacttgattcttttctcactgcccagtggaaattttggctctgagaactggcacaaataataatactgattactgctgttgctgtaagcaatacttttttttttttcctctgccccaggagtcctatgttttctgctggtatcattgaaactgtggcagagtaacttgttagtttctaagtaggatagaacctcaaatctcagactcctagtggttcttgaaattgtcatctttttattcctctgaagttcattcaatatacttttattaggctaatatttccaaagcaaacaatctattattacatttctatcagaatgtttcagtgtcttccagttaggtatagactaacaccaaggaatcaaaagctttttaattatattgtttcatcccattttgtccaattaagtatagattctcaccaagaaattaaaaacttttcattatatggctccagcctggttttaaaagttgcatttcttgttccccgaacataccccattttcatattcccatcatctttcacctgttattgtctatcatatgattatattgtattttctttcatttatgttattctctaagaacactttaacttacataaagttgaacagttggtctagtggtggctatgaagcagcacctagatcccctttcagggctgaaggacttgtttttccatctgctgtaggtgccacagtactgtctgttctggcggtcgaccttggacaagcaaagcttccttgcccaacaccattcctctttcgcagaggcagcccatactgattggctggccactgaagggacactaaggctcagcctctcccccaaaattgggacagttctgatggtcatctgagcttcagaccttctcatggatttcagtgatgtctttgttgtgactacatcacagtcctgctttttcctttctttttaataaatttcctgctgacaaatctctatgtaaatgcctactgcctggggagtccaaactataacagttaccattctgccttagaatgcaatccttttgagaaagggcttccgttttactttgttgtatttgtattaggcacctctaataatagttttcccataaatatttgttgaatcaaattgaactaaatagggtaaagaagctcaccttgcattttgatcattagtatgccaaataaatgtagaatatggagccagaaagtatcctctaacaacacaatagtggatatgaagtgataaatatattttataatccagaatccagaaagacctattactcaaaagaagagtcaatgggggctgggggcagtggctcacgcctgtaatcccagcactttgggaaaccgaggcgggcggatcacaaggtcaggagatcgagaccatcctggctaatacagtgaaaccccgtctctactaaaaatacaaaaaattagccaggcgaggtggtgggcacctgtaatcccagctacttggtaggctgaggcaggagaatggcatgaacctgggaagcagagcttgcagtgagccgagatcgcaccactgcactccagcctgggcgacagagcgagactccgtctcagaaaaaaaaaaaaaaagaagaagaagagtcaatgggataataccatatgaattacacctataaaaagctagctgacttaacaattcttattttttctatctaaaaagaaataaaattgtatttgccttacacaagtgagggaatggtgttcaggaataagttcagagaaaaagagggaatgtatttatttaccctttcgtttactttcatgtataagactaatggtctaaactgagtggtagaattcatatgtctaaaaccaaataaggatggttcaactttattttttcttattggtcagaactattgtaagcttgcttttaaaaagcaatcttgagtttattattcttttaagcagccttggtgatcagggagaagggtgtcatctcttatctttctatgacagatttcttttttaacttttgagagtaggaaaccctgatcatcttagacataagttgtcaccaccaccacacctttcattatagattcctatactgttagtcataggggagatcctaaactgaaggagaagacagtttaccttctggcatctccagcacagcatatacattctgaatttatagctgaataggtttctaagacctagttcttaatgtggaaagtgtttgttggagtttgtgtggtgtgatattctagtgtgccaagtggagttaattaagaaaggtttttctgtaagaattgagtcttggtgaatgagagtggggatggacatagccgcagacaggccattataaatgggctttggcaattcaatatggagagcgctaaaggtgggctccaggtagggatgtcatatttgcctgattggataagaaagtgtgatccagagagtcacagagtggactccaacatctggaatgtaatgtatgcctggtatttatagtctgctgaagtctggctggtgcttagggaggaaggagttgggagaagggcctgtaaagcatatttaaaaggtcttatctttgagagcctctgcattgggctttacctccattttatagttgtgaatttgggggttttatcttatttcttgcctggttaaaacaaacagagctgaaccctgatcccaattcttgattccaaatccattgctctttctattgtgttattactatttccagcagtcgtcacctcactgggaagtctacctctgatctttgtgtatcaaacctgtttattttctcctataatttttttcttgttgttgtactttaattaattattaaaaaataagcaatcttgagaaattattcttgaaaaatttaagaaattttaaaacaatagcctaatataagatactccaaatagctctaaggaaatagacataggaatactttgcaagtagcagttttgaaagaaagctgagaatatgagaaacaatcccattatcaaaacctccaagtatatttcaaaataactaccccctacccacttaagttttctcgttacttctttaaacactggaaagttttacataactgataccgtattgtaaaatgtgttttcagtttgataaaatagctgctagattataaacaagtgtttgctcttgggcttgttgagtaccgtgttgaatgtcaacaggtgtgcttgtttcatgtttgggctttgtggtaaacgatggatcatggccttccattaaaaagaattcttcatctttcagcttatatatcatctattttcccagttgagactttaggtcattggcttttaacatcaacaataacaagtttgtgagcctgattgtagttttcttccccctatgggttttttttttttttttttgtagatgtagttctacttgaaatgttattctcagagaaaatatattgaaaatagtcatagttctttgaaaaggttgttctttaattatcagctggtgcatttcatgtctaatttataatttattagacaaccatttattattatttggcaatacttacatgcctctgttaacattttcattgcacttattttgtaatacaaaaataacaaaggaatgtgaacaatttctttctcttctaaatttatactcatttcgtgacatttaggttacaacctatttgaatttttttcccccattaaaagtaacaaaagaataacaaatgaaacccttgagtactctgaacaaatatatgatacttgatgctttccctatttttttcccggcttctcattctgggtgggaatacaggtgggacaactcttaattatacagaatctccccagaaattggaggcttttaacatcctgggtcctaggacgcctgaagcataccctagttgtgagaacagtagtgtgtgcacacatttccaattccttccaggagaaagagcccggtgcgatcttcttactcagcttctgattctactccttattactagttatcttaaaggttactatagcagtcttcttctgcctgttatcttccctctccactttttattctcaagattctaacctttccatttttttttaatgccggaatgccccttgccaaaatacttcagcggcatctgtattagtctcctagagctgccttaataaatgatcacacactgggtgacttcacacaacagaagtgtattttctcctaaatctggaggccaaaagtccgaaatcaaggatttggcagggtcatttcattttgggggttccaagggaaaaaccatcccaatgtctctgtcctagtttctggtcattgccaaccatccttggaattgctcgtcttttaaacacaacaccgtaatctcttcctccatcttcaagtgcttcttctctatgtttgtgtcctttcttcctcttcctgtaaggctacttccattagatttagggcttacactaatccagcatgatctagttctttacctttattacatctgcaaagaccctatttccaaataaggttacattctgatgttccaggacgacatgaattttgagaagacactattcgacccaccacagcactcattgtttttaacttgaagtccacacttttcttgtggtagagaaagcctcagatgataagaactgctttgtttatccaccttcctgtcttgccagtgtcctctctcagtcagtgaactctgggtcagacttgtatgatgttccaccttcgcaatcgccctcccttgttctattttttttttgtgcggggtggggggggggttggggacagagtctcgctctgtcacccaggctggagtgcaatagtgtgatctcggctcactgcaacctctgcctcccaggttcaagcgattttcctgcctcagcctcctgagtagctgggattatgggtgcacaccaccacgcccggctaatttttgtatttttagtagtggtggggtttcaccatgttggtcaggctggtctcgaactcctgacctcgtgatctgcctgcctcagcatcccaaagtcctgggattacaggcatgagccaccgcgcctggcctatcccttgttcttaaatactcctcacatgatacttcctctccttcttcctaccatttttgtataaacctctggtcctaggttaaacatcaccttcttgactctgctataagactctgtttagagcagttgtccctctaatatactgctagagtgtgtatcccacagccaatcattgtgtgtttgcactatggcaaacactggaatataacagcaaatgaaatggatttgattccacaaggcctgaggcaaggattacatcaccatgtgtatacagagcattatccgtgtcctctatatgaattaattgcttagttaatgctagttagttgtaggtgtccttcataaatggcataggaggtatttcaccaatttatttacacgtgattatttaggagcagttgcattaataattctacattgaaatacttgttctgtatttttactcttgatttggtctgctttttagagaaccttttatttatacaaagatagcactgtgttttcaagaaatgcccttaaaaactagtcgtcagccttgccttaaaaatgttaatactgattggtatggtttcagacttctaaaactaaatggaggcaaacataggctacatatgataacaactccaaaccactttttttttttttttccttgagatggagtctcactctgtcattcaggctggagggcagtggcacaatctctgcccactgcaacctccgccttcagagtttaagtgattctcatgcctcagcctcccaaatagctgggattataaacatgtgccaccacacctggcaatttttttgtatttttagtagacacgggatttcaccatgttgaccatgctagtcttgaactcctgacctcaggtgatccaccctccttggcctcccaaagtgctggaattacaggtgtgagccactgcatcaggcccaaaccacctttaaagaatgtgtgaaaattatggattcaacttgactttgcgtataaattgaagagaggatttttggtttacctaaaatatttcctctccacatagaattacccaaaatcaccggccatgatcaaccctagccatggccagcaaatttgagagtcctatgaactggagagaaattctaagcttaaatactacctactgtaaattttaagttgatcttctccatcaggatgttggctggaccaagcatttggtgaaaatttctccttaattagaaatcagaagtaaaagttttgtactttagtaaggatattataaagctttcaaggaatactagtgatggatcttggaatatatttaaatgttcaataaaatgacagaaatctggatgctatggacataatgtctttccttccatgtatatttgataaatttcatatcagttttcaagataaaaatcttatcttaaaaatttttagtggaaaacaaggtaaaaatgtgtgcttcttcatccttaatcctagggaattggattagcccaatactttatatgttttgagtgagttaatcaagcttttgcatatttcacaatttcttatatttaaaaactcaaaaatgtgtttgcttattctggatccagtcagaattctagaaatgagcacaaaatgcaaaataagattttaattgcaaaaatataaccattggctttaaaaaagataaatatggcttaatacacagcctgagcaaaaatttacaaaataacttattttaaaaaaagtttcggagctaatgattaagaaataaatcactactgaagtcaatatctaatgcttgaagtttagagttaattcaattgataaaagatggagaaagatgaaatctgactttatacctccatttcacaattatctgagaaattagtagcagggttgaactgagggccaaaacattgaaataagctcctgcatggaggagatggcaatgtctgcagctcttacttcttggtagcaaaataattaggtaaataggcttctgatttatcaggagcttgaattgtacacagaaaacatgcaaagtttattaacatgtggcattatttgtatttgagaaaaaatgaaaatgccataattatcctgatgccaccattcccgatcctcccactcccaaccctatttctaggctgtgaattatccctctgaatgaaggcctagaaatgcctctttgaggtaagtgttcagtgttgacttgacttcgctacggactacaaggttccaaagacttggagaagacagtccagtaacagtaaatttctagctgttgtttcgttttttgaggtgtgtgaacacaaaatatattttgaatttataattgggacatttaggacagggagaagattccttatgcattttctgatagtaaataaaagttaaataaattattctatttggcttggttccaaaaaaggcttacctattaccaagtgaagaattattgagcatttctttgtgaagtgataatttggcatgcagtcctctccaaaacataattgccaaaatattaataaaattgagttgatttgtaggtttctgtaaagcaattcattgaaatgcaatgggtctggtctttttttaaagtcctatatttgaatattataaaaaaatataggattttgatatgtaaccaaaaattgttttgttggataacaaactatggcaaaacttagctagctgccttaaattaacagtcattttagtcacattttccacaagtaagcctgttggctgtgtgtgtctgtgagtgtgtttgtgtgtgtatgtgtgtgtgtgtggtctgggatggttcagctaggttacctaggacggcctcacccacatgtctgaggctttaggggagagacttgggccttccaactcatggtctctcatactttaagaaactgcccaggcttgaatccactgtggtgcaataattctctgaagcaagacccattgtgtgagcattatttcagcctctgcttctgtcatgtttgttaatatcccgttgtccaaagttattcacatgccaaacagaaacaagctccacctctacaacttgtagttttgcaacatatatatgccatatatgttcatacatatatatgtgtgtgtgcatatagcacattagtatttaaaactactaatgtattttatatattttcttttgggattatagcaatttaacatatggcatctatatgactatattatatttcataaatcatttcaatattaaatgatacttctaacttagtattgtcaatttctttagctaagcaatatgtttattacttttgaatattatgttgtcctaggattatagctttgtactgagttgtctttcagacaattagatttattgtttgcctgtttgatcagaaaagagagcctgtgggtcatttgatacatagcaaattccatgataataaattatacctggtcatataaatagaagattctactatattttttaaactatatttatttcaaactttgaaattttaaaaagcaaaatactagatagaaaatgtattagtggtttggatttaggtatatttggacttgaactagcaatgtgagtttatagaattaactttttataacattaaaattgctatctattaaattggaaatgtctggcaaaggatattcctgtaaactattctagaaatgctcaaagtcatgtaattctagaagctcattttttcatagagagataatcaattctgttttggcaaagtaatgttctacagtagatttctggaagctatttatctgaattactaaatacaacagaataatagtataatcgaatttcttcttaaaaaggaattgtgtcagaataataaagtatattatgatgaaatgtattactataatctaacaaaaatataaaactatgcaattattaaagagtattctattttcattgaatgctactcttaattcagtttctatcctccctcctccccaacatacacacacttctatgaagctgacccacttcacatttttagcagaggaagggaagttgtatgtgggagaagtgtcagatatagtgtttctaagtttgtaattttatactgttttgtcttaattctaacatattttatgatatgtcttcttttggagaaaaaaggaggagggcgtgtatcagtttgctagggctgccataaggaagtaccacaaactagaaggcccaaaacaatagaaatgtattttctcagggttctgcagtctagaactttgacattaaaatgatggtaggaccattgtcctctgataactctacaaggtgatgcctccttgcttcttccagcttctggtaggcctgggggttccttggcttgtggcagcatcaggtcaatttctgtcacgttttcacatggatactgtctctgtgtctgtctgtgtccaaatttttctcttataaacctagtagtcctattgaattaaggcccatcataattcagtatgaactcatcttaacctgactgtatctgcaatgaacccatttccaaataaagctacattcttgggtaccagggattaagacttcaacatatctttttagggggacagaattcaatccacagcaggacctaaggaagagcagtgttaaaacttttgcattaattgatactatagatgttcagtaaataataattattgttattatcgttatagagacatgtgtttgtcacttatatggtaccaagttttcttttaaatattttgtaagcatttactctttcattgaactgaaatgagaagccaagggtcttatcctgaagtgataacatacagattagcaaattctgttttagactataaaaggcattcttataatcagacattttgtttttgcaatttttttgtttgttttattttatttatttatttttttgaaagagtcttgctctgtcacccaggctggagtgcagtggcgagatctcagctcactgcattctctacctcccaggcccaagcgattcttgtgcctcagcttctcaagtagctgggactacaggcaagtgccaccacacccagctaaccttttttttttctttttaataatccgtgtattctgaaagtttttgatgtctatgaagttttgacttgcaaaatattctagtagtttacaatttctcagtaggcttatttaaactttgtttattattaagaattgaaccagttccagacaccattaccaatgaaatcaggcccaccatagcagctgaagtcgaccatttattacatgcacttcatttgagtcttattaatgctgacatctgttcaagtcttcattaccatattaccacaactggtcccttgtcacatttatcctgattctttgtagcataaacacaaaagagaaaaatacatttccaactaatgataaggttatttataaatgagatatattcaaagaatgattttccacatattggacacatgctattcatttctcaattttatttttacctttagacaaaaaaattttaaatactgaattataaacaagatttaaaattttattcatgaaactaaaagtatgttttaatacacagctatacaagacaattacttaagcatacatttaagcaatgtaattaataaaatattttctttgtgagtttgagatgttacttttatgaattttgcaatagcctaatgaaagaataaaaattacgtaatttttgcaatgatcattcattcatcatttttagtagcaacacaattctatgatatgttatggttgtaacagtggctttttcaatgatgctttcttaatgacactttacaaattacactaatagtctctcacggcaaggttggctgtatgtattttttgtaggctttataatatcatctgagtctattattacctctgacatttttctagaggccagttaacttgtttatattcaaacaccgagtgggaaatgccagcatcaatcaccgtttctacctgtaatgcatagtgataatagcaaccacgggtagtaagcactttgctaagtattgggcttaaatgattccagttattttcctcaataagactgtattataggtattcccatttccttgaggacaagagtaataagtaattttctagaagtcatgctttagtagatatatttgaaattagcacccaggatatctgactccagaatatgtcctcccaagtgtgatgctctaccctacttatcataatggttctgcctgaaaataattattatgtgcctaccatatacttatctccaacactattattactgagtggcctaaaaaagaaggaaaagtaggtatccttttctttagggtagggaagacatacaaaggtgaagctactgaaattaattataatagcagtatataacatggtgaatccttgtcttgaaaatgtagtcaagagattaggctgaactggggctagtttttcattgaattggaacttaaaagacatactagagaaaagcaaaagcaaaagaaagtcatactgggtggacaaaagggcaagggctagacctaaagagaataaaaacaagcatttgaaaatcagtgaatgaaagacactctacaaaagaacttgctctattttaggtagtacctttcaaagtcacctttcaattttgaaatatggtaaactcaacaattgactataactgttagtaactaaaattattatatctcaagtattttttgaaaaatagttcaaattatcaaaattttgaattctttggagactaaaaaaattaataagttgtcaattgacttcatgcacaaaatgtatgtggagtatatacaagcggcatttttttttaagacggaattttcctcttgttgcccaggctggagtgcattggtgcaacctcagctcattgcaacctccacctcccaggttcaagatattttcctgcctcagcctcctgagtagctgggattacaggggtgcgccaccatgcccagctaatttttgtatttttagtagagacagggtttcaccatgttgtccaggctggtcttgaactcctgacctcaagtaattcttccacctcgacctcccaaagtgctgggaatacaggcgtaagccactgcacccagccacaggcagcaaattcttaacagacactatagaatgagcttaatagaaaatttgtgtcgttacataatttgcatttatggactgcttctagaagatgtgaaaaatagaggaaagaatatgcgttgaggtcaaattttataaatcaatgttttcctaaatatacatgtattgactatctctgctacaccagagaatgctgtttctgcaggacattaacaagggataaacatataataatttccatgtataaacacatttgagatagggtgttcaaaaattacataggttttgtatggtgtatccactgaatacttctaatgagctgagagatattggtaaagttaacaagaagagtataacatgcagcgtttctcaaaattactatactacgcactattttgatagcgggttatggtgactgcattaggataaatctgcattctcaagatttttggggtaaagagatatgtggtcatatcctatgaaataactgtgagtcgtttaggaaagacttagacatcgtgaacccatgtgatgtggaccatgagtgaatgaaaggtttggaaaatggaagatgtcattcataacatgaaactttcaggtgaaagattctcaggaacaaaaatctctaaagaatacaagaaaaatgttcatgagagaaaaatcagttttaaccatttctcagacccaaagagcatgaaatctatcgaatcaagtcagaagtattctatcaccttaccagttttctctcctttcttccaataatgttcaaaactgcaactagaaactaaggaaacaggtgaaaaagagagggagcagaagccggctgcatttccttttactgattaatatatctgccagctatgactctgggcattcagaagaaggagagtaagccttagcctcaaatggcattgaagcagattgattcatgttttcatatattaattaataggtgattatttaatccaaattttatgctgtgacttaaagagattgtacaaccatttattatccaaaaatgaaaagaacagttaatgatgtcaccaattttaaattattggtctgagttattaccctgaaagtataaatgttaaataaggaagagtagtatattagttttctaggactgccataataaagtaccacagactgggtggcttaaataacagaattttattctttcacagttctgtaggttagaagtccaagattaagatgccagcaggattggtttcttctgtggcctcactccttggggtgtagatggctgtcttctctctgcatcttcacgtggtttttccttctgtatgtgtctgtgtgcctgtcctcttcctataaggacaccagtcatattgaatgaggacccactcattttaactttaaagagcctatctgtaattacagtcacatctgatgtactggggattaggatttcaacacacaaattttgtgagggtgacacaactcaccccatggcaggtagaaagttacaattccatcaagtcatattcaatgcatctgttgcatattgttatattctctgatatatcaaactacttttgattttctggaattaatccagcttggttattgaataattgctcttacgatgtatttctagattctaatataatttttaaatctataatcacaagatagattggcttactgttttgttttgaatatattatttagggtttgtaatattaggttgccgtaaaagtaattgtggtttttgccatggcaaaaagtaattgcagttttgctctcatgagcatttttcttgtattctttagagatttttgttcctttgaatggcaaaaaccgccattactaacaccaacctaatatacattatgttggcaaatctgtggcaacacattagaaaatctacagaaaatgggtgattttcatagcaaaattgcattaaaatatcaagaagaaatgaaaatcttagataaaatatttaaaaattgtgacatatttaccattttaaaatattctaggaatatgtgagttgttatatatactaactattaatactttctgctacaacacccttaaaaaccacagtgattaaaaagtgtatattaagtaaattctgtgatgttctcattgggtgagacttttgtggctcttctccaagaattggctgaattcacccagatatcaagcaggcaggaatcagaaaaggagggtgtttaggggagatatgtccactctaaactgcctcagtagcaccccatcagctcagctcacatttcaactgtaaagcacatctccacatgaggggctaattatggtagttcagctgtgtgtccaagagaaagaaacaagtttcttgagcagtgagttggtccctgccacagatgggttcacagttgagtttcagccaactctaaaaactcttaattacaatgttttctaaattattccaagctaggaaaagaaaaattaagtcctcagtctttctgacaatgaaggataatttaattttaattttgacttgattttaataatcttgacttttaggcattaaaaaaagatgtaaaactaaaagcattttttcagctattgcattttgcaaaatggagagcttcttggcttaggaaacaatttctggaatattttagatagatgatagatttgatttatatctacatatacatataaatcaaaataagagatctcttcattgaaatatagttatacatctttaaatttttaatcaacacttagggagatggcatgttattatacaaaatgtgtcccttttaggttcaagtcaatctccaaatttctgttctgtcgcttcccagttttttgacattatgcaggtcactttgcttacttcacctaaattttctcacctgtaaaatagacataaatataagagtatcacaagattcatacatgattcgcatggcataatctttgaattgacccagagcaatggacattacagcacggccatccacacaaaggcagtgttttttaatcatcattaacacctttaacattatatcaaataatttaccttcggtgttttcccattctataatcttcaaggcttttgtacagaaaacattgtaatttcatactttgagtatacttacttcatcccctgaccctttcaaaacatataacaatgatagacaaaatgtgaaagaaaaaatatcgacacaacccaggcaaaaataaagcagacaaccccaagggctagaaattggacaaaaacaacaattaggattgaaattggttcctacttgggtcagggaaaagaagtttcaggcaactatgaattggtatccacgggtaacagaactagaagtaattcctataaatttggagatccattccaggtttactgctagaaaatagcctggggcagagtttcccaaactgaaaggcagttgccaaggttcatggtgtctctggagtgggagactatagctaattccagaagaaggaggggctatagcacatatcagggagagtggaatctgcagggaatatcagaagaaacaaagtctctggccaggttccgagccaagcttccctctggcaagtggccatgtaactatatttctaatgccaatattacccccaatctgccagcataaatactatctttgtatttgaagacaaaattgttagttggaagaaactatagaacatctagatagagagggtcaaagagagagagagaaggaaaagaaacagagtgacaagcaaaggaaacagctcctcaagaagattttgcaaaataaaattccaaaacccacaaggcaagtaaataattagttgctttaataaaccaaggcaaaaaaattaattagcaattaaataaaacaaacctatgtttatttcctcaaatgcataaaataataataatagcattgaggaagaaacaggcattattaaacagaagcacttactagggtaggaaaaagaacccaaagaattattagaaatgaaaaaaattaaaaaccattcaattagtaaacaggggtggaaaaatccctgaactggtagaataactagtagggagcacagtttaagtgatacctctggttaagataacattaagaaattcgtttagaacgcagcctgtacatatataacatgaaagagaagttaatatccaggaagggtcgattgaaagactttagcatgttgaaaataatatcaagaaaatgattaaagaggagatggagaaatgaagcaacccaaaattgataatggatttgaatttttttgaaattcaaaagtgcacaaaaagtctgcatgtaaatccacatctacccgcaccactgtgaaactgcagtgtgtatatttgtatgtaaactgagagaaaagacatacaaattataaaagtacaatgaagaaggcgacatcaaacttctcatcaaggctaacacacaatcggaagcagtgttcttgtgttcttgttcgtcgaagtaccaagggaaaatcacctccagctctgaagttgacatctgcctaaactgtggttcaacagtataaagaaggaaaaacactttgaacaaacaaatcttaaagtctctatgacacatagacccactctgaacgaactattggaggatttcattaaaatgaaatattcctaactgaggttattgccaagcaatatgaataaacaagtggtatattttaaaaagtagtattttgcagagaatctttagaatggccaactatgtaactttttggaaaaatgattagaatcaagtgttataaatgaaacatttcaaatgccttaaaattgtgagctgaaaatatctgagacagatctcaatcaatttggagagtttattttgccaaggtttaggatgcctcctgacacaacctcaggggtcttgaggacatgcacccaaggtaatcagggtacaacttgcttttatgttttaggaagacatgaaacaataataaatatgtgtaagatatatattggtttggtgttggtggggcttctggattccagatagataagcacaaaatgttgcattcttttgagtctttgatcagcttttcaccaaatgcacaatttagactggctcagtgaatcctcattgttacataaacagtagggcagaggaagcaatggaatgtgcatttgtctcaggtgagcagagggatgactttctgtccagtagctgtgaagataagctgtcagtttacattgccagggtgaaactcaactgttttgtggttaagatcttgaggcccacaaggaatttctctgttggcaaattatgagggaggtatggagctttttttatctttgtagctatcttacttaggaataaaataggaagcagatttgccttggcttagtgatttgggggtctgagttttttttattctttcacaagatctttatatgttaaatgaaattcctaaattaaattaagcattatcacttctgcaacattttgcattacacaacacctgagtgagaaggccttataaaatccaaagaatgcttagctactttcagtatactttttttctgtttcatttttctttttaaatttagcaaagaattcatattgagttatgagatatgtttaaaggaaattattctcaatgattaagatttatttctcttccttaattctatttaaataaaaatgaaaaatacaaagaaaaaatgtaaatatttatatatatattttaactacagatctattcctgaaagagggggttaactatatttcagaagtcaaattggattttaaatatatttgaatagatgataatttggggtaatcttatagtcagtctattaaggagtgaaaactactactaatttctcactgctttatatgctaattttagtttccatattaaattttgtgaaagtatacatgttctcattttaaaactgttaatatcctgacattaagaatatttaagtctatataaccacttctaatcttcagatttttttctcccacttttattttggcaaattaataaagtaaaatttaacttcaggagggtcataaaagtgactatcattcacctaatagacgaaagtattttgtttgtttgttgtttgtttgtttttgatacggagtctcgctctgtcacccaggctggagtgcagtggcgcgatctcggcccactgcaagctctgcctcctgggttcacgtcattctcctgcttcagcctccccagtagctgggactacaggcgcccgccaccacgcccggctgatttttttgtattttcattagagacggggtttcactgtcttagccaggatggtcttgatctcctgacctcgtgattcgcccgcctcagcctcccaaagtgctgggattacaagcatgagccaccgcgcccgaccgaaagtactttcgtttgcttcttccagacgagcttgttggaggtcctccacccatagtccccacatcaaccccttgatagtaaatcaaggataattgatagatttcaacatttgacttacaaagttttgagaaaatcataaaactaacatacatctttctctgttctgtaattgatgttgtgaaagaaaataggatcttaggacctcatactcactatgctaaagggaaagttaagcttgggaactgagtcaggcaaaaactgcctctttttggttcacagatagctgtaatttctcagccctgtgtcatagcctcattttctcttttcacatgtaaaatgtagatttactgaagcttatcagagccttacaagaatgtaaccatctgcttcatggcctatcctccctcccttttttcctccttgcactttctctaaatattgatgtaccgaaaaacccttttgaaaaaaactcaggtgacagatgctcctatgatttatatttttttcctggatacatcctcccccttgtctaaataaacccgtatagttttaggcctgccttagtcacgttttggtgtacggtgtacaaattctgaatggtaatgaacatatgatccacaattttattttagagtgctcttattttgaggggcaaagcttgctaattattttttcttctaaattctgataaataaaaatattcacatggggcttccagaactagtttgctctattcctgtaacaggtgctatcatatccgttgtgctccagaaaactttcagtatccacataacctgactgagaacttttctagaaatgtggaaggatgctctgcagttaaggccagcttcagaggcatcttgattttatttatttatttatttatttatttatttatttatttatttgagacggggtctctcattctgtcacccaggctggagtgcagtggtgccatcacggctcattatagcctcaatctcctaggatcaagagatcctctcacctgagcctcccaaggtgctgggattacaagtgtgagcttccatgcctggccttgaaattcttaataatgctctccttgaattttaatttgtgttttgtaagttaagtcattgggacaatcaatgaggggtgggttgaaatgtgggggttagagtcttgcatgacctaccctggatagcttcttggctgcctttgcttcaacccctcctaacaactgctgctgctctcctccttggggaaagtaaaggaggtggtggggaagggccatggagtagggaagtggagaaggaggaaaggaagtatacatatgcatttcactattttgcaccccttcccctagtgtgggcctcagcacacatactgggagggttggacatgtgcccagcagcatctcaggacaggtagtgcccaaccccagcccgggctgttaactcaatggtggattcattaggggccccttgaccactcccatccagatgcagagtatgtctcagctgggatgcagtgcattgtggttttcaggtggttggatggcaggcccgtgggaaggagagcttgacttccctgcccttggccaggtccccacttttacattatgcccttggaaacaaaatgcaggttcagtcgcttgccacctacagagtccaataacaaaggagaggtctggtatttcaagacttttatttcaaaactagcttagaggaaacagtaccagcttcctgtcttaagggtcttgctttgcttttggagcagaaagcaggcacttttaaaaggcatgagaggaagtgagcaggtaggtggtctgcatgctagctcagtgccttatctaccagacaattgagttggcatttttgtggtcagaaagggttgtagaggtggcccaaaactctccagatgggagagagttttgtagcgggactttgggttgcaaactgaatgttatctctggaggcaacctcctggtgtgtgacagcccgctctggagtttctaagtccacagttaaatcaacttactttgtagggagtgtctgctgaagagacagtaaaaggctataattgtgtttctaaagagctaagtaggaagcaggggaaaggaggaaagaggagatagaaaagagagaaaaaataattaaactagctcttagattaatgggggtatttgagtatagtctgggtcccatgaattatatagccagcattatctgcagtgagtatatcagccatgggaagtgactgagtcaatcactctaagataacccaacttctggccaggcactgtggctcacgcctgtaatcccagcactttgggaggtcgaggcaggtagatcacgaggtcaggagattaagaccatcaaaaattagcaaaatacaaaaataaaatcagcaaaaacaaaaaaaaaaaagaaaagaaaacccaacttccttgcctttaggtagattattccaagacatgagttttacaatgttttttttagagctctccccacccaattaagtttattgtggtaactggcttgataaaaaaaatcctgtattgagtgtactcatctgttttcacaccactgataaagatatgcctgagactgggtattttataaagaaaaaaaaagctttaatggactcatagttccacatttttcctcacaataatggcagaaggtaaaagacacgtctcacatggcagcaagccagagaaaatgagagccaagtgaaagggaaaaccccttataaagccaaccgatctcatgagacttactcagcaccatgagtacactatgggggaaaccacccccatgattctattatctcccaccaggtccctcccacaacatgtgggaattatgggagctacaattcaagatgagatttgggtgaggacacagccaagtttcttttacatgatgttgctttaaaatgccattataattactttgtattattccccatcacctgtatctcactaccacacttccatggattattatgttacacagtgttgaagagatgtctggctaaacaaaacccactacatgtttgaattccaggcattttgatgtttgtttgagagatataaaaagccttttaaaaattagggctgtcactgaaaatctgggaaatttggtaactctataaaattatatatatatatatatgctttttcaaagaattataaacatcaaaaacacttctgttgggaggccgaggtgggtggatcacaaggtcaggagtttgagagcagcctgaccaacatggtgaaaccccatctctactaaaaatacaaaaattagccgggcgtggtagcacacacctgtaatcccagcttctcaggaggctgaggcaggagaattgcttgaatccaggaggcggaggttgcagtgagccgagaatgcaccactgcactccagcctgagtgacagagccagactctgtctcaaaaaaaaaaaaaaaaaaaacacttctgtccaattggaaaattggtatctttggcacatatgatagtttcactcacgtccatgtgaagagaccaccaaacaggctttgtgtgagcaataaagctgtttatttcacctgggtgcagctgggctgagtccgaaaagagagtcagagaaaggagataagggtggggctgttttataggatttgggtagataaaggaaaattacagtcaaagggggggtgttctctggcgggcagagtgggggtcacaaggtgctcagtaggggagcttttgagccaggatgacccaggagaaggaatctcacaagacaatgtcatcagttaaggcaggaacccgccatctggatgtgtacgtgcaggtcacaggggatatgatggcttagcttgggctcagaggcctgacattcctgtcttcttatattaataagaaaaataaaatgaaatagtggtaaagtgttgggatggtgaaaattttagggggtggtatggagagataatgggcaatgtttctcagggctgtttcgagcgggattaggggtggcgtgggaacctagagtgggagagattaagctgaaggaagattttgtggtaaggggtgatcttgtggggttgttagaagaaacatttattgtgtagaattattggtgatggcctggataccgttttgtatgaattgaaaaactaaatggagtaagagaaggagaaaaacaggtataaaaggtctaagaattgggacgacccaggacatctgattagagagtgcctaaggagattcagcatagtcctgccagcagagattatttatttacttcaagagttaagagtggcagtttgggaatagtaccaggagatatcagctgtgatggcttgcagaaacagtgtaaaccggcagtgtaaacaagagcagggcatgtatgagtagttgagaacggtgaataggcgtatgactagacagaacatagtagggatgacaagtttttgggggcacagtctaagttgttctggtgtctggaatgagactggggcctaataaaaaggagcatctatacaggagctcaaatgggctgtaccctgtagcattctgaggacaggcctgacttctgagaagggaaagtggtaaaagtattgtccagtcttttttaagttggtggctgagcttggtgaggtgtgtttttaaaagaccttttagtccattctacttttcctgaagacggaggaccgtaagggatataaaggtttgactgaatactaagagcctgaaaaactgcttggctgatttgactaataaaggctggtctattatcagactgtatagagatgggaaggctaaactgaggaattatgtctgacagaagggaagaaatgactgcggtggccttctcagacgctgtaggaaaggcctctacccaaccagtgaaagtgtctacccagactaagaggtattttagttttctgacttggggcatgttgagtaaagccaatttgccagtcctgggcgggggcaaatccccgagcttgatgtgtagggaagggaaggggcctgaataatccctgaggagtagtagaatagcagatggaacactgagaagttatttccttgaggatagatttccacgatggaaaggaaatgagaggttctaagaggcgggctagtggcttgtgctatagcatagcctgcctttgctggtgtgtggcgattaggcctggtggaaccaccatcaataaatcaagcgtgatcagggtgaggaacaggaaagaaggaaatatggggaaatggggtgaatgtcaggcgcatcagagagatacagtcatgggggtcaggtgtggtatcaggaataatgtggaagtcgggattaaagtccaggccaggaacaatggtaattatgggacttaacaaagagtgagtacagctgaaggagccggggagcagaaagtatatgcgtcaggtatgaggaagaaaatagattttggaagttatgagaaatgtagagagtgagttgagcatagttcgtgatttttagggcctctaaaactattaaagcagcagcagccactgcacgcagacatgagggctaggctaaaacagtaggtcaagttgtttggacagaaaggctacagggtgcagtcctggctcttgtgtaagaattctgaccgcactaagcatgcctaggaaggaaaggagttcttgttttgtaagggattgacgtttgggagattaatcggccacaatcagcagggagagcacgtgtgtttttatgagaattatgccaagatacgtaacagatgtggatgaaatttgggcttgactgaagtaataggggctgtctgtgaagccttgcggcagtacagcccaggtaatttgctgagcctaatgggtgtcagggtcagtctaagtgaaagcgaagagaggctgggatgaagggtgcaaaggaatagtaaagaaagcatgtttgagatctagaacagaatagtggattgtggagggaggtattgaggataggagagtatatgggtttggcaccacggggtggataggcaaaacaattcggttgataaggcacagattctgaactaacctgtaagccttgcctggttttaggacaggtaaaatgggggaatggtaaggagagtgtataggctttaaaaggccatgctgtaacaggtgagtgataacaggctttaatcttttcaaagcgtgcagtgggatgggatattggcattgagccgggtaagagtgattaagttttaataggatggtaaggggggcatgatcggtcgctaaggagggagtagaggtgtcttatacttgtggcttaaggtggggagacacaaggggaggatgtgaaggaggctttgaactgggggaaaaggtggcaatgaggtgtggctgtagcctaggaatagtcagggaagcagataatttagttaaagtgtctcggcctaataagggaactgggcaggtggggataactaaaaaggagtgcttaaaagagtattgtctaagttggcaccagagttggggagttttaagaggtttagaagcctggccgtcaatagcacaacagttatggaagcaagggaaacaggcccttgaaaataaggtaatatggagtgagtagcctccgtattgattaagaaggggacggacttactttccactgtgagagttactcaaagcttggtgtccgtgatggtctagggggcttctgaggcgatccggcagtgtcagtcttcagccacgaagccgagaagatctgggaaggagtcagtcagagagccttgggccagcattccaggggctctgggagtggctgccaggtgagttgaacagtctgattttcaatgggttcctacacagatgggatacggcttaggaggaatcctgggctgtgggcattccttggcccagtggccagatttccggcacttgtagcaaactcctgggagaggaggttctggaggaacccctggcagctgcggttcaggtgtttggagttcttgtgtgctggaaatgtggctggggtttgtctcacagtggaggcaaggaattgcaactcagaaatacattgctacttggctgcctctactcttattactgcacatcttgaaggcaatgttaattaagtcctgttgtggggtttgaggtctggaatttaatttttgcagttttatttaatgtcaggagcggattgggtaataaaatgtatattgagaataagacggccttttgaccttttaaggtctagggctgtaaagcatctcagggttgctgccgaacgagccatgaactgggctgggtttttcatatttgatgaaaaagagcctaaacgctatctgatttgggataaagaaaaaggagcattaaccttgactatgcctttagctccagccacctttttaagagcaaattgctgggcaggtgggggagggctagtcacggaaggaaacagtaagctggaccaggtgtgaggaggggaggtgataaaaggattatagggtggaggagtggaggctaaggaagaattgggacctagctcggcctgctgaggagcagcctggggagaaggcttataacattatctacattgaatttaacctcttacccagacagtaaatttacttccttttatttataatcttcatgtgttttattgataaacatttgcataaaaattagctaaaatttatcaagtgcataccatgtattgggcagccttctaagtacttcatatttattaattcacttatttttttcaatactcatttattaaataatcctcattttacagttgaagaaattaaactcaagagaaagaaattgggtagttaagtaatctacacagtcacataacagtaagaggcagaaacagaatgtgaacccaaacagtgggtttcagaggtgccttcttaatcaatttattattctgctactttgtattattctgatactttatatcagaaaatgaagaaaaagagaaagtgaccctaattgtctgaagtgtttagttcatccttgcattccctatcacacgatagtaataaaaaaacatttttaaagttattttaattatgagcatgcatacaaaaattctaggttaatgggtggatggaatgcaatgattatacaaactaaaaagtcaagaaatgtagttcttaggagtaaaacttaaaaagagaaacaatgcatcttttataaagcatttaatgttacacaaacttaggaaattaatagaatttgataaagctgacatatgatatctactggaaatttgaaagcaaatattgttttaaatgttgctgtaaatgttgaaataagcttgttaattaaatggtgtctgttcaacaagctctggctgtcttggcctatgcaatacaagaagaaaataaaacaggagatatgcagattggaaaaaagcatcagaattttctgccaagcttatgactatcgatgtagaaaaccaaagaagttctcatctacactcatggaactgagagacttcagcaatgttgctactcataagagccacatgaaaaaattaataaccttccaaaagatcaatgaaaaaacaatcaagatacgtaattaaaagaaacatttctcttgtaacaacaacaaaagacattggatagtcatagacctttaagaaaagatgtgtaagatctatgaggattagtgaaggttttacagaaagacctaaattaaggtgaggtatgaataggaaggtgttaaagcaagaatataaattttccaaaatgtatgccaaaaattattttctgaaatatttcccaaatctcacagttcaatgaagtgccaatcaaaaccatatcaagatttttttctgtggtgattttttaaaacttaatttgaagtgtcgttaacagagagtaagtatacaaaaatagtcaagagaaacctaaaaaacagaagaaggaatgaatcaatctaacaaatatcaagactttttacatagctaccttaattaatagagtgcagtatttgtgtaaaaagaagccattatttcagtggattatcacttcaaagcccaaaggcaaaggaaagaatacttgagaaattagtatgtgagaggattgattatcagtttctagttatttctaatctataagtagaccagaagttgagtttgattatatgtgtgtgtgtgtgtgtgtatatatatatatatatatatatatacacatatatatacatatatatatgattatgtatattacatatttgagcaaaatttgctactatggttatatttttagtgaatatttgaggaaataaataaaatccaagaaaatagcaattcaatcttatgtcaataagtaactgtgtaattgtcaaataaaaaaatccataaaatgaacattattaacaactaatacaagaccagctcttgagtagaccatgaagtgtaactaatcaacaattatggcaaagttttttctcttttgtgagaacgaattacaatgttttccttacagctttttgaatcagatattatggctctgaaagcaaatttaattttcatcgcaattcatgactcagatatcttttcagtggaaagcagtgaattggctgccaattagattgatgctatttgaatctgcatgcatgttcttgaaataatcctaaaagaattcaattcaacttgctgacaaaagaactgatctatactgctgggtttttttttctttttattcatcctattatgttccctaatcctgagtatattttttactaggaatgaatgaagattgattcagtcccaattacagaggccattcagttaattaccctcatgttatccatataatgtacacctatataaatgaaagtcacttttctctgaagtctcaagtctatgaatttcttatgggaccagtgcagaacaggtaatattgcaattataattggatacatatgcttgtaattacactgccccactcagatcttcttactctacctagtatctgataaaactgatagttgggaaaatgagaaatagaattctgattcggtctgtaatgcagatttatttcttgaaagctacaaaagtgatttctcaaaagacaactgctatattttaaaaaataaaatcttgcagtaaacaagtttcctaagagagtatatctcttattctagagaaaataattcattgttttagaaactagaaagcctaagtagcctagggtttcatagaacataagttgaaattaattgacctcattataaataatgacctttcctaacagagcatgttgatgagtatctgtatgtgcagaagtgtcttaagaaaatgattggtgaaggcaatctcatactatgccttcagacactcatttcttttaattttcatctacttcttacatttcactgtttttccaagctcatgctaaatttctcagagttgcttctttgttttgctctgactcattgcagtttctttgtgttacatacatcctttaagtccccccttgagatggtaataatctgttttcgtctctgccaactccctccccaacaacacggcatatttaattgtaacttcaggaggcacaattattcttattatagaattcagacaatggaatgggtaaacacatataagatgatgagagtcagaataagtatatataagagaaaaatagttcatatgttgtcacatgtgctattgtgacaatacaatagtgttgtgtatggaaagcaaggatcttctcccaatatctacaggcttattatgtgataagtgatattttttctgtggatgaagagacagaaccagaaaatattggcaatgctaacaggacacatgttagttcaactgtatggagaacttcctgccaggcaatgggatgagttaactaaggacaacggagctgtgtcatgctaatgattatctgaggagtgtgaagtttaccctattgtcaatggacagctaagaaatagaggaataactttttaacaatagatcaattctgttcttgccaaatgaatatttagccaaatgatgaattcagcatccatttggtttagataaaacaatgtacttagagtagaggactgaaaaataaggcagatgatttggaagagatgcacacgtgagtatggtccatgtagaggtcatagttagtattatgaaagaaaagttaatgggttttacagtatgaaagaaggcaaaaaggagagtgctgggagcatggaaaacttggagaaagacattatatatatatacatatatatgtatatatatgtaatgtaaagacattacacacacatgtggagtaaaaatgcaatagaaaataagacagatgaacataacattaaataaactaaaatacttttatgacagatgagaaaattgtataacgtaagtgctggggttggaggacaaaattttgttcctgggattaaagaatgctggtgaattgaaaagatcaagaagtaataaaagaagtgtcttcatccctttatattgttatgtcattgaactctcttatggattgagtagaagattacaagtgtattgcccctttgtttttctcaattaatttttatagaagtatggtgattgaaactaccagtatcaatcaagatggtctaggatatggaatgataacagccaactgtagcacatcagtgatttcagaccacacccagactgttggagcggccactcaaacattgctaatactagagcagaaggctctgtgtggtcttaattggcaattaaatgagccagcctggaaatgacatgagtcaggtcaagtgtacccaaaactgattgacctgatagatatttaatggttgtttattctcaagtagtgaggatatcctacccattcactagctagatcagagctgtgtcctaatgaacatgggtactctacacgcatattaaaaaacacttattgcttagaagggtatgatggacttggggacttagagaggaaggttgggaggaggatgagagatgaaggactacacactgggtacattgtacactgctcgagtgatgggcacactaaaatctcagaaatcaccagtaaagaacgtatccatgtaaccaaactcacctgtactccctaaactattgaaataaaaacaaaacagttgttggttttgttgctgtgttattgctattgcaatacaaaatatgaaaaaaaaagaaccaggaatatctaagtcagttaaaaatagtttattcgtactcccagaaaactcagaggccataaaataaatagttggaagcaaaaaaactagaattggagagaattagagtgaacaaatttgcaacgaggaaaataatgccagcaatgaaactaattatttatgtgaaaaaatatttccaaaatatcaactaaacatttaaaaagtgacaacctaaacaatcatttaattaaaatgataaatgatcaaataagacataaaaataaactctctagaaatatatacaaaaaatggaaagacttagaaactgttcttataaaattcataaaattatagaaaattataattcctatttttattaaaacaatagtaaaatgcatattattatatatgctgatgggattgtaatcagaaaaaagtgttttatgagacattttgttcatagaaattaattataatgagatggtgttaaatagaaagaatatcaaccataaagagaggttgcctaaatttgaaatcagatcataacattcaccacttctggatgaaaactttacattttaaccgtttaaatatttatttgtttccatccatctcctagaaattaaaaacatacctaacagtgagcaaaagatgcagcctaatgaggttcagtgaagcattgtttattttaccgaaactgaagaaaacatataataaattattctgtacagaatttgccacacaaaaaaattaacgtatctccataatgtaatgaatgcaatacattttttaatgtattcatctgaaaagatatttaatatattattatgtgacaaaaaccagtgaaaaaagagtatgtgcagtctttcccacttttagaaagaatacattagtataagaacaaataaacacaagaatatacaaacattagagcagtttcctttggcagatgcaattatgaagaaattttaccttagtattcattttaaatattttaataataaataaccttaaattacttttatgataaaaaatagaactgtaacaatagaagctaaatgattcatttaaagtatattccaaaatattatgttggtagtaggataacaacttagaaaagtccatgtaccatgtgctacacattacagttttaaagtgcctttagtaacatctgacaaaagttgataatataacacttaacaaccattgtacagaataaagagccaatactactgataaaggcatattacccacaattggggcatgaaattttcattttccattaagattcattttatacagctcctctaaatggcctcttacgagcccattcctgctgtcatcctgcccacttgcttacataaacagaaatttaacagcccatattcttgaatccgtacacttaacattaagtgggtgcttctctgaaatagtgatacacatgtttattaggaaatatgatgatatttatcatttaatgtcatgctttatttggtatatggaaaattctgtaaagtgaaagcaatttccaaatttataaattattttctaatgtgcatttcaaaagcagtagctccattttccgagttttaaatctgaacaagaacaattctatttgcccttgatctatattgcattgtattgatgtgatatttcatggaccattattttataaatcagatttctaacatacttaggacctaagttatgtcaatacctccaatcaactactattatcctgttttcatatttgcaatatatttataatagcttcttagtagaggtagctaaaattataattaaaagcaagactgtgcgtttgtcacaggagaagaatgttaaaagatgctgttactattaggattattaataatgctattattttactattattatattcttcaaagcagaggtgtccaatctttttgcttccctgggccacattcgaggaagaaacattctcttgggccacacataatatatactaacaatagctgacgagcaaaaaaaaaaaaaaaaaaaactcacagtgtcttaagaaagtctacccactatgtgttgggctgcattcaaagctgtcctggatcgcatgcagcccatgggccacgggttgaacaagcttgctttaaagtaatagcatagtgcctaataaacacctagatatatttctctcagataattactagtgaagtttatagaactagatctgaattttgaaacttgtctctgattggacagaggcataacaaacaacattctttgccatctgtaagtaactacagttcttagttatccaagtgttggaattggggcaggcaacagaaagaacattgtatttgtctgcagaatactcttgattatctcttcaaggaaaggagacttggaataggtcttgtcttcttcatgtaagtgtgctctttggaaaacatatttgaacttgcatgcaaatgactttcagagagtttgcaacctggtagagcaaaccatgctttgttgacctggatcaagactcccagaagaggggcaacttccctagctccataccaatcagcttttaccacttcttggattccattatccatgattttttgaacacagcaaatatcaacccatcaaagttactttatgaagagaagcacccattctccttgatttacgatggggttatgtcctgataaacccatcgtaagttgaacctattgtaggtagaaaatgaatttaatatacccaacctgttgagcatcatagcttacccttaaacatgttcagagcactcatattagcctactgttgggcataatcatctaatgcaaagcctattttataataaagtgttgactatcttgtgtgatttattgaaagtaaaagataaaatggttgtatggatactcaaagcatcatccataaagttttaaaaaatcattaagtcacaccatggtaagtcagagaccatctgtagtagactttctttcataaggaatacaagtaatagcccaaataaacatcttaaggaaagaacataaaagactagggagaggggtagttgttgggagtggggaacatgaaaaagagagagagagacagatatcagagccatttttccaggctcttaaagattgtcacagggtaggaccttcagggagaaaaagttaggaacgtgtttccacactaacatccatgctaacattaactcccacaggagtattcagaaagctcagtggtgcctcttactcttatatgatgttttaattatgtttatatatcatccagtgttttgggaggcagagaagaggctggccacatcttactgtagcatgggttcttatcctatgcctcttttaccccattagatattaaagtgaagttgtttcacatgttgtatgtggatgactgaacagaaaacaaatcatgagcaatgctaagttttagtaattactgatcataactttaattgtcactcagttgcatctagaaataggtgtcatttagtccatctattaagtttctccagcaaaacagaaccaacagaatgtgtttacatataaagaaagagagatctattttaagaaattggttcatgtgactgtggaggtctaatgagtcaaaaatcaaggtgctggcaaggttggcttcctttgaggcctctttcctgggcttgtgaatgtcagaccacttgctgcctctccacatagtctcctgagtgtcttgaactcctcttataaaaacacctgttagactgggttatggcccactctaaaagtctcattttaacttaacctctttaaacgtcctatctccaaatacagtcacatttttaggtagtggggggttaggacttaaatatataaacgttgggggacacagtttagcttgtaaccatccaaaagtgaaatttatgtttctccattttgttatttgttgttgcaatattattttaataatgaattatttgtaggtaatggtaaagcatgcaatgaaaacttccatgcctgctaaaacgcttttaaccacaagttagaaaaacaaacacataaccacccaacaaaccaaattcttacaaacaaaagtagaagcaaaaacatgtacagatttcgcaaaactgaaataatggttgttagagatgtttcagagttggcttaatcccattaccctggctccgatccttagtgattctgtcaggtccaccctctgctatgtccagcctttgtcctaggactggttcctggggaagattacagcctcataccctcaagtaatgtccagaggaagaaggaattgtactttctgaggttttctttaagcatgacataattcctccctgagtccctcaggaaacgtcttttggtatttcatttgtttgactaaggtcacttttccattcctgaagcaatcccatgtccctcaataagcttagcctgattcctatgttatttactaggaagagaaagaggtattgtgatgaactttgaggtcaaacctagtcaatcccccaaatttatggaaacaacagtggtggagaggtggactagatttgagggctaacaccataatgacctctacaattgcctatgaaaaagaaatgtaacttgcgtttaaattttaacacaaacacatttaaatgaagaatatatttcatagaaataatggcaaatggttttctgtaaatgtgtgctatttccggggaggttgaagagattggtgttgaagggctaataattgtattacttcctgcattagattatggtccagtgaccataatgtctttaaatcacaagaaaataagttggtttaatattggcttccaggacatagaatgtttgtttattgtgtgaagtgttgcattttaactgggagcaatggtagtttgatttcatttccagtgccttgaaaacatctaaaatgttcatctctctactaccattgtaaactaagacacatcaactacaatttctgacaacatttatattagctttattttcactttacaggttcttacacatttgattaaaaatatgacagattcttacaactctgaaattaaaaaaaagtttaagtccttgtattgtgctgtaaagtccttattattttgcaaatatttttgtactttgaagcaaaaaggtgcaactcttaattttgcatttgaatgtcttcatagatctccaattactaacatagcctaacaccgatattcataatatgtaagagattgtattttcatcacaatgtaggcaatatgacaatttgtttatggaatatggtgggaaagtaaaagttttcttttggagaattattcaaatcatgatggtcctgcacctgtggtagcatcagcatatacggagtatgagtgtttagaacaatgagtgtttatgatctcaggaagaaaacatgaaacaatattcagtgagttcaccagaactcagtcttcagtacattcttgaagagccatagaacaataaaagaattttgttaaatgctcaatgattatataaataaatgagatataattgaacaattatgactaatgaggtccggcagtatggaaaataaactctccttggtcagaatcttcctgcttacagataaattgaattgcccaaagaatgttcattgaatatggataacttgagttcattctggaggagaccctctgaggactgcagaacatatctcagaatcatcccaccaaagagtgaggatctagggtgtttatccatcaatttccattccttgtgggttaagcattgcctttggtacaattattgtcctgaatgtatgccacacctatcaccaccctcagctccctgcagtctcaaagcttgccgaagcagggaaaggtgggaagctgtctgtgctctgtgcataagggaccagtctgcaggtgaactccagggtaagagagaggatatgaataggacactgacagtttctgctattgtaagttaggctatgttatggtaagaaaaatatatccacagacacctgtgccttgtttctaaatatatctaaaattgataggaagaggattctgcttagtgcagtcaatgagagatccagactattggaggagctgccacctcatcagggcatatcctagaactcatgctcttcccgttgtgtagcataggtagagaaacaagaaaattgcagagaagttgtattacttcagcatgaaagtagcacacatcaccacagccaagaactatccacaactagttgcatatcccaatcttactttcagaaggcagaaagttgttgagaaagatatgttctacctgcttgccattactctctgtgttacattctatcagtctggtcatagcaatagcagtggtgagaatagttgttgtaatagtagttgtaatagtacgtagtcatcattgtaatcgttgtaattagtgatgtataaagaatcttcgcaacaaaagagagttgagaaatctgaaatattttccagaagatattatttttagaaaatgtaattgtttgacattaagaagaaagaagttagttatcatcccaactatatccaattagtatactttcagtgtaaactggaggaaagcccatcccaaaataatttaagtactactagcagtactgaaaagtccagagtacactgcatatcaggatagcttgatgcaagggtacaaatactgtcatttataatttacatttgattctgtcctctgtggggcctccatttcagatattcagacagaacttgcttcatgataaaatgaaaaggagatgggttcagaatagacttggagaggcagtaagagtacatgaagtttagttttccttgacaatgacattttaagatattatttgctttctgggccaataagctgcttgctttgattatttccctagaggatactgttaatggtttcatcaaaagcagaggcatggtatttaattttgcttgcccgaacctccctcaacttttggatttcagtaagtccgctctatgcaagcactatatatgggcattcaagctcctctctaggggttcttcttactcgtaagataaagctgcttcaggtagattctttctcccatggatcatttctggatcacaggaaacgtacatgaatttttctcctagccaaagtacaggtttgtaatttgttgccaaacaggaacaacattttccttcagacccattattaaattcatagctgtccctgctctttgcgattttccagatatgatttaaacactggcccactgtgtctctccctaactgcaacagacacatttaaaactccccaagccatccaaatgaagtccctatataaggcttatggtgggggaaaattaccacccaccacactctccctttaggaaggtgaatttctcacagagctatccaaagaaaatctgattatatatcatcttgccaacttcaacaggtaggccttattatatttaaagagggtaaggaggtttaagagtgccatggattgaattttcttggtccctatcaaattcatatgttgaaactgaatcctcaatgtgagtgtttatttttatgtgaagtttttgggaggtaattagatcacaagggtggagcccttactaatgcaattagtgcccttataaaagaggcctctgagagataaatgagaaatagtgagcacagagtgaaaagacagctgtctatatgccaggaagtggatgctcaccaaaggtaaaatcttcccctgccttgatcttgaacttgccagactcaagaactgttagaaatacattcctgttgtttataagccacaaagtctatgatattttgttatagcagtccagacatacaagtttttttaatgatctgtaatactaactatatttgagttctactaagtattaacatttcactaatctcttttgtcttagaatattagtcaaaactcccattttaagagaagctacacagtcttgggttcggttcaaatccccttagaaaaagtgataactactttctcaatatctcagaaaatgtttcattggtcctgattgagtgatgggtccatccctaatataatccttgagggaagaacatactttgattcccttcacatctgagctgggagatggagctcccacagaacacgtgttataagaggtggagaatggatggttctcccattctggtggcaaaaataatagattccatttcaaaaccttatattgtgaagtaggcagtgaggggagcaattgagagcttttataggctacatgtaacacaattaatggtgtcaataacagtatcattttggcacattaatcaattatcgattaagggagtaaaggtggtaagaagaggtggtattgtacttcttctctcctatattgtcaaagatctccttcttgcttctttcatggcttttggcttcctgatggcttccagcagcttttgtgttgttcttaggatttacatatcgtttgcttgaataaaaaatacagacaattttgcattttttataaccatatgaaaactctttggagtaatacttgtatttgaaattattaccatgacaatcattacacacatctatcaagattttatttctttaggacattctgtatctaaatttctaggactttctaagaagggagaaaaaggaacatcatacacaattattttaaataaacttcaaagtacagttagaacagaaaaaaacttttcattattttatacattttattatgtaacttttgtccatgttgagttcactctaagtcatgatgctgttcctcacgtttctcttaattatattctctaatagtagaatgtgtacagttttaatattctctaagctttagtcaagggcagctttgttctttaagccttcatatattcaacagctatcaccaaaataatattcaatctttaagccaattttctatgtcagataattctttaaaatgtcatggttggttgctttaatttcatcaccccttcgaaagaccgtttgggctctaaaatggttacatatgtcttggttaatgtcctcagtcatggtgccttcagctgtcttttcatttctggacctaggagacttattcaatttccattatattgtatggctaatcaaaagaaggtctttacaccctacttatttagctgtcagaagtacctgtatcaaaagaaaaatacaaaccaaaataatctaaataagcatttcttaaggttatgactcctgcactgaatttacggaaatatttttggtcaatttctggcttttgagtataattagtacaagtgatcagagaatatgaatcaagttttcataaatcgttatcacttgtggaactctttccagagctaagaggatacaactgtttgcatacctagttcctagtaatattcataagtggacaactttcaagctctagcttcaagtttatcatcatctgatttacaataatttattctttggtgccaaattaaaccttttgttcctaactgcaaagagttattaagattaatagtttgtccccacaaaagattttcaataaatttcccttttgtcttccttttctgatgggtgagaagggagggaacctttcagaaagagtgacaatggatcagttacagagataaaatcaacagcaactctctggatttacttccagtaaacaacatcaaaatgatacagggttggaattttgtgaatctattagttaatggtggtttttttttcttaaaaaattttaaactgctctatttctacctcctggatcctttcaaattctatcaccatctactttagatccattggattaattattttacctgctcagttttactaattatttatattattggagaaaaaatattgccaatactttaataaaactcagcatatgtacaatataagtgggaaattaaagcagagaaacagatgcattcagattaatttataaaatatgctctaatatatgtcttaatgatatattagagtgaaaaactatagttaaaactttaggagtagcaaaatattaccaatcatttgcagagatatgaaaagaaaatcagatgcccaattactgaagcattgttaaagcagactttgtctcctttaggaatcactctctttctaatcccccaatttttttttgtttcttggaaagttacaactctgtatgtaatttacttagtattttcttgaaaaaaaaaagaagaaaaagtttggaaccttagatttaactcatttctggatagattattcacatttttaaccagatataattcttgcttaagttctttgaataagtttttcataaaatactgtgccttgttacgtgatatgccaaccacaaattgtacttttaatatttaaggtggagttctttctattagaaatagcttctcttaaaaagcttttattttattttattttattttatttatttatttttgagacagggtctcactctgtcacccaggctggagtgcaatggcgcgatcttggctcactgcaacttctgcctccctggctcaggtgatgctcccacctcagcctcccaaatagctgggaccacaggtatgcaccatcacacctggctaattttttggtactttttgtatagatgaggttttgctacattgcccaggctggcctcaaactcctggactcaaaggatccacctgcctctgcctcccaaactgttgggattacaggcatgagccactgccccaggacttaaaaagcttcaaagaaacactttttacaaaagattaaaaacaggaaaagagtaagagaataaaccctacactacagaatgaactagttatcatttactaacaaatggtacaagcaccacacactcacagtatatcccctctcccatcccatctactatgatatatatctacatatatgtatgtgtgtgtatatatttacacacacctatacctatgcaataatatcttaaaattctaaaataaggaacatggtctaagctaagatcttactacatagttaaaatcaatacaatttttacttttccaggaattttaaactgtgggattactgcatgtgattaccatggagaggggatgaatgttaataaatgaaagtgcataaattatatccctattgatttgtttgaattccccttttgtagggaattagtggaagccttagcttaaataactattgaagtgccagcagcactttggttcaccttttcttcaatattgtgattctttttgtcataagatgcacatctctgaaaaatactgatttgctttcacaagacctattaactttctagtatcagatcttacattttaattgcagagagaatctagttcctccagctgtcattgcttaaatactaagaagctttctgcaacaccttgaatttaacaacagcatgtctacgagtcatgctattatctttccctgtttcattaatctgtgcagtattagaacttctacagaggacacgattgaaatgcatacttgctctgagcacctcttagagctgtggctctgccatggactgtggaagcctgcactattttagggcagttaggcatgtttttcctatatgccaatggccattcctctaaagtgctttgagctttagtgacttccaaaatcaaaacttggtgcaggctggacacggtggctcttgcctgtaatcctagtaccttgagcagcggaagtgggaggattgctttagcccaggagttcaagactagcctaggcaacatagtgagaccctttctttacaataaaatagaaagctagccaaggtggtggtgcacacctgcagtcccagctactcgggaggctgaggttggaagattgcttgaaccctggatgttgaggctgcagtgagcctttattatgctaccaaacaccagcctgacagagtgagaccctgtccaaaaaaggaaaagaaaagaaaagaaaaaaagtaaagtaacttgatgcaacaattgaagtaaaaactaaagttcttggggggaatatctgactccacagttatttaaccctgacatagtcattgctaataatttccagtagctttatggctaagttcatcacggcatacatgatactaagactttctggattctgaggttctttaattacagaaggttaaaataatttggatttattttttgatcctcagttatctacaaaaatgtttaaattatgctcagtattatctggttaaaacagcaagaaagtagatgaaatgttaatttaaatatctataaaatagtcaaaaactttaaagttaatatgtaaagcaacaaaattctgttttccggaaaagtaatttatgtgcaaagaactttattaaggaaaatctttccttttacaataatgaaagataaataaattgccactgtggttattttcactttcttaaatacagtcacattttgtgtctgtcagactgaagataagaaccccacagagaaaagctaagaacatgtaattaattcattgatagaaaccattatggtttgcatttcactatctttataatattcatgtagactatatttttctttgctaacaagaaaaataatgtttcatgtgtttttgaaatgtgttaaattagctattaaaagctatgtatgattaaagaagattatgaactatagctgacatatggagacatgtatttagtagacatatagcaactgttatcaggaccagtatgaataagtaatatatattataaaaactataagcagcgatgacaaaaaaagaatacagaatattttcattaacttcaatatatgaaatcaagtaacagcagcaattaacaatcactgcaaatgaatatacaacaatatcgatcattcaaaaagtgaaaaagaaaattaattaacaacctaattaaaaatcacagaatgccctcaattattctgtttaagtaagatcatctttttagttctcagtttagaatttggactaattattcaattaaatttcagagaaacatcaaccttataaaaacctctattctgggcatttaaatgtagattattaaatattcttaatgaacacagagcccatccagcattcctttgatcattttaggatatctccccttttctgtccttaaactaaattatccttcccttttatagatggatcagagatagcagctttttaataaaataaggtcaacttgtaacattgggatctttttattagatttttttttcaaatactagtgctttggactgctgccatttccttacacctgaactgaggttcttttttctgctgtgtctagacatttttaaattgtcttgtccatgtggtcatgaattaggctttataaaacagaataattatattttgtgactaattgtcagctgtttctactaaagagaatcaaggtttattttcatttgcttgtttgcattatactctagataagtatattcaaacagctttcataccagttacacacaaacacaaatcacagacaaaagatgttttaaattttctaatgcaacctaaaccatttaaaatgtaaattgaagcataattacattttctgaacaaattttaacaagcatcttgcttttaaagtctctgtatgtttttgcatgagtgtgcagcagcttttatgagctaagttgttcaagggctgcagacatttttcataaagaggaaactgtttagcacatggattctaggtctccatccgtgttaaatctttaatatttggtttgatttgtttctgcatcaactttcttttttttttaatttaaggatttatttttgccttgccccaactcagtacctccttttgtttccaaaaacttagccacttactccaataattagtcagtcatgtagattttcctgtataatgaagaagagaaataggggagaatcgtgtatcaaaccactaagaacaaacgaaccaccttcctcaaaaccgttttgtttccacagtcactgtccagccttcaggcacgaatgggaatcctttacacttctccttttcattgtcttgtttttcaggctttagactcctcctagtttttccatctatcccttcaccagttttggctgctttccacatccttatgcagagcaaatcaacccagtttcagcttcaacctccaatctttagtcttgcgaatctacctctactgcttagaagatgtctgtgtgtagaggagggagggtggtaaattttaaaaagaaacaaaaagttacatgaagattgataatatgctttaactatttgctgaaaaaggaaggaaagaaagtgagaaagatggagaaagagagaaaattgggcatatttctggtatttccatcttcactagaaatactaaattatattatgttgcattgttactacatttaagccatttatttaaaggtcctattaggagatataggacctatatatttcctaaatacctatttctctttaattttcataaaaacatttgagctagtttatattattatgcccattttacagatgaggtaattaaggaaattgtccaactttgcctcgctggtgagggtagaattgtgattagcatccgggaggtctgactctagagattatgctcctatgactactttgccatagtttaaacagcgtgtgggttgttgctcctagcctggcatggtgctggacaaatattttcaagtcctggaatacaatttaggtaatgaagattttcaaatggtctaccccctgtgcctgtccctggcatttaacatttgttttatgaatatggacactttgacatatatgactgcttactgtatctgtaaacaaatctgaatccttgatgatgcttctcatttacttaacaagaccttttctcaaagggagtacaaagaaacttcattccaagccccacataaatcatcttgaattccgaatcaatggtgactgaacaaatgtggttttgtggtatattgcattgttttacattcctgcttctgttaaaatcactattggtttcttttgctttaccatgatttttttaagtcctgggcaggcacgtatgtggcttattttcccagtctctgtgagtttttggtacagttatccagagttcaaatagagggttacataagactaccattgactcaggtgtttcactattagggacctccttgcagcctgggcaacttcacaaaccaatgtagatattactgcagcacaaggcaaaaggactgtgtgaaccttctggtgttaaagactagaactctgtgtgaattattttctattctgaaagccatatagaacaatcaacacaattagggagacaatacagtttttcttgtattttaggagactccgaggaccaaatcaattctgattctctaacttcctacatagtgtattttattaactagaaaggatagagtttactaaatggcaattttattgctccctttgcctaggaagagagcagtgggatctttagcttctttattacaaaagcagtcagatattttatacagtaataaaagcaccagctgccatttgagacagctaaagctatgcgatgagtactatgagtacaacattagtaatattttctaagaaaagtgttcattaaaatgtaagtttttccctaaccccaaacactactggactataaatagttatagacaagctaccttaaactggttagagaaaaaccatgttaggtaatacctttgaatacctcaactattaatgcatagaataggagaaaataaagttacagccaaaatgaattggggcagtacatttatttccctcaaaagtgcatacatttttttcacttgtccaaatgttgttatatttccaactgatatataaaaggagaaaaatggcctggtagaatgcatttgctattattaaaatttggaattttttttaaagctgctgtgtctttcaagtaaatctcccaaatcaattaactgctctagttattaacacttactagcaactactttccacaagtcagtagctaagagcatggcatacaaggaaaggaaaacactatcagtgtcttctaccagtcaatattataatcaaagagatgaaatttaagtatgtgaaatgatacttagtaaagtcaaacaagtgcttgtgaaaactgttgacacaacgccatccgaagagttcagtggtaatttggcaagggttgtaagagtaatttttcagaaagaaaataagatttgagatggttcttgtaagatggatgctatatattcccatattgtaaacaaaattatgaaaaatttgattaatagagaaattgcaacccagagcctgccatttagtaagaattccaatatttgtcaaatgtatactactataagaaattttaatttgcacaacaaatatatgagaactgtactattactatttgcaacctacagataagaaatataaggcttagagagtatccttgacattgacaaattccgtcatagaggaactgagtagtcagattctgaagcacaacattctgatccaaattatcatacagaattatgtgtgagcttaagtgaaacttggaacaagaattggtctggagactgaaatttgcggaggaagaaagttgtttgggatcaggttttgaaggtctttaatgttagcttgaaaggattaaggcttagtaatagaaaacaggaaggaagtgggtttgtaagagagtgtgggtgtgtcctaaaagtctgtgactttttttattgaaatgtgttctatttctttcaaatgcaagaacctttagaaagaatgccttgcttcttatttcagtaatccttaagaataggcattatactggaaacagagtaaattagcataaactcttgagatggacagagatttttttagggcacttttatttttcaactcatatcattcctgaaatctggaacatgttatatgtgataaaatcactttcctatattatttttcccttaaacctctagttacagaatcttataacatattgtatcttataacccatggtacctttgttagaatttaggaaaaaggtcatttgaagaataaaatataatatgaaataaaatacaaccttgaatagaaatgtaagaaaatcattctaaaatataagaaaaataaaaaactaaaccttagggaacagagaaagtatcaagaatagagataaatttgcactttaaagaataaatgaatttttcatagtgcaatagggtgagaaaggtgacatatgctcatttaatggtgaactaagaccttgctaagtaatggagaattttttaaaaagtgcaagcctgcttattgatttgtcatttcaggtgggcaataaagattaaaagagtatgatgggtagctatgttactttcatcaagttaaacgaactctgtaatttccaaattcctaagctgtaaaactgccacgcatttagggccataaaggctactgctctctgacatcccccaaagcccaccgtagggacttgctcctttgtcttctcctgcaggcacaagatatgatgaaaacacattgacttccacctaaacagtgtcaccataagagaaaaatagcatctcatgacccatcacatcctgagagctcccttttcaccagggccgaattctgagcagcccaagtacaacccttcttccagggtctactctctaggccactgtgtctcaaagtagtgttttcctagggtgaaacccccttcccacatgttctaccatattcctttgtaatatcacactcctaattttctgtgatgtttttttctctcttaatgccattgacttctactatcagaagccctattctatagtaaataaatacttttaaactctcaatatcatcagtgaaatttgccagtacatttgggaatgaactgtaaaccctctcctgaggttttcacagctcatgtggaagctgcctaccctctgatgctgctcttctggcataggctggtacaggcctttgtccttttaacttcccatgactttactcaggtcatttctcttctactcccctataatctcctcacatcattattattgttttttgtttgtttctttttaaatttattttttgaggactcagctttggtaaagtataatttacataaataaaatccacaaattttaagtgtacaatgcgatagttttgacagttgcattcatttttgtagccactgccacaatcattacaaaggacatctccctcacccccaaaagttctctggtacaaccctgtgttgtcactctcctcactccagtccctcactcctagcaattactgattggcttccattattatagctttgcatatggtattttaaaattgctttcatttttaattgacataataattgtatatatttatgggatgctgagtgatattttgatacacatgtacaatgtttaatgattacatcagggtaattagcaaacccatcacctcaaacatttatcatttctttttgttggaaacgttcaaagtcctcttttccagctttttaaatatatacaataaattgttgttaattatagtcatcctagtgctatgaaacactggtacttactcctcctatctatgtacttattaaacagcttttgggcaactacccatctctttcctcaccttgagtaatcactatttcactctacttttatgagatcaacttttttagctcccacatatgggtaaaaatatacagtatttgtctttctgtgcctggcttattttacttaacactatgtcctcgagtgtcatccatatcagctcaaataataggattttattctttttttaagattaactagtatataaatgtttatatatttcacatttctctttttaaaatcttttctttttaattttttgtgggtacatagtaggtgtgtacatttgtggggcacatgaaacattttgacacaggcctgtaatgtgtaatgatcacatcagggtaaaaaggccatccatcaccttaaacatttatccttcatgtcacaaacaatccaattatactgttttagttatttataaatgtaaaactaaattattattgactatagtcaccttgttgtgacatgaaatactaggtcttattcattcttctaactattttttggatctatcaaccatccctaatccccaccccccagctcctgagccccccactacccttcccagactctgataccatccttctactctatacctccatgagttcagttgttttaatttttagcttccacaaataagtgagaacatgtaaagtttgtctttctgtgcctagcttatttcacttaacataatgatctccaattacattcatgtttttgcaaatgacaggatttcattcttttttatggctcagtagcactccattgtgcatatatgccacattttcttcactcatttatctgctgatggatactcagattgcttccaaacctttgctatcatgaacagtgctggaataaacatgggagtgcagatatctcttcaatatactgatttcctttcttttgggtatatggtgagcagtgagattgctggattgtctggtagctcaatttttagttttttgaggaacctccattctgttctctgtggtggttgtactaattttcattcccaccaacagtgtacaagagttcccttttctctacattctcaccagcatttattagtacctgtcttttcgataaaggacattttaactggggtgagatgacatgtcacttaagttttgatttgcatttctttgattatcaatgatgtcgagcatgttttcatatacctgtttgccatttgtgtttctcttttttgttgttgttgttccaatttaatttagctctgctctgatctttgttatttcttttcttctgctgggtttgggtttgatttgttcttgtttctctagttacttgaggtgtggcgtcagattgtctatttgtgctctctcagacttttcaatgtaggcatgtaatgctatgaactttcctcttagcactgcttttgttgtgtcctggaggtttaataggttgtgttgctgttatcattcaattccaataactttttaaattttcattttgatttcattgttgacccaaagatcattcaagagcagattatttaatttgcatgtatttgtatagtttcgaaggttccattcggagtgaatttccagttttattccacagtggtctgagagggtacttgatataattttgacttttgcagaaatttattgagactcatactgtgacctatcatattatctatgttggaaaatattctatgtgctgatgaaaggaatgtataatctgcaattgttgggtagaatgttctgtaaatatttgttaagtccatttgttttaagatatagcttaagttcattgtttttttgttgactttctgttttcatgacctatctaatgctgtcagtggagtattgaagtcctccactattattgtggtgccctctatctcatttcttaggtctagtagcaattgctttgtaaatttggaagctgtggtgttagatgtatatatgtatttaggattgtgccatttttctgttggactactccctttatcattatataatgtccttctttctctttgttgctttaaggtatctttcatgtgatataaaaatagctactcgtgcttgcttttggtttccatttatgtgtaatatcttattccaaccctttaccttaagtttgtatgagttcttgtgtgttaagtgagtctcttgaagacagcagatacttggttgatggatttttatccattctgccattctgtatattttaagtgaagcatttggaccacttacatttaatgtttgttttgagatgtcggttattgttctgttaatcatgttacttgttgcctaaataccttatattttgttattgttttacaagccatgtgagatttattctttaaggagatcctattttggtatatttcaaggttttgtttcaagatttagaactcattttagcatttttttagttttggcttggtagtgatgaattccctcagcatttgtttgtctgaaaaagactttatctcatcttcatttatgaagttcagttttgctgaatataattcttggctgacaattattttctttcaggaggctaaagataggaccccaatcccttctggcttataagctacctgctgagaaatcagctgataatctaataggatttttttttttttttttttttttttttttttttgtaggttacctgatgcttttgtctcacagctcttaagattctttcctttgtctggacttttgataacctgatttctaagtgcctaggtgataatctttttgccatgactttcccaggagttctttgagcttcttgtatttgcatgtctagatctctaggaaggccagggaagttttcctcaattattccctcaaatatgttttccaaacatttagctttctcttcttcctcagggacaccaattattcttaggtttggccacttaacataatctcaagtttcttggaggtgttgttcattttttaaaattcttttctctttatctttgtttgattgggttaatttgaaagccttgtcttcacgctctgaaattctttcttctacttgttctagtctattgttgaaattttccactgcattttgtatttccctaactgtgttgttcatttacagaagttgtggttgtctttttctttatactatctatttatctgaaaaatttttcatccatattgtgtattgttgttttaatttctttaagttggttttcacctttctctggtatctccttgaattgcttactaatcaataaccttctgaattatttatctggcaattcagagatttattcttcatttggatccattgctaggaagctagtgtgatattttgggggttgttatagaaccccattttgtcatattaccagaattacttttctggctccttctcatttgggtagactatttcttaaaattattttttaatttattttttattggattgatttttcttttaatttaatttttttatccctcttaaggatcagactttgatgtttattttagcctaatttgattcttggggcttctaggggtgaacactctgtatgagatccttagttatagagagtctttatgtgctggctttccctcatgcttggtttagtggttatattcttgatgtgtggtcactgtctcctgtggaattggaatgacagtaatctcttgaagtttatctcgttctctcagagtgtacactttatttatttacttaattttttcctgatgttttatttactgagttaatgatttaggcttcaggctaataggggagttattcctgagtaggcactggttgtggctaaggcaggtgggtagatgtaatacccaatggtgggctaaggtagcctccttgatgaaggaggctagtggagctctcatttagatgtgctgaggttttatcagggagaagagtgggagctacttcagctcccctgccatgtcagcaagaaagctattcaccttacagcctcactcttgtcctagtgtttcagccattcagatcagacaggcacttcttttcatggacagaaatgttgatgttttgagtggggagggattgtgactctgctgtttttccaggcatggatctggagtgtgctcctcctgtggggctatactcaccctggatttttccagaaaggctgtctatagaggcctccatgctgcgttcttctgggagaagccccaattgtgtctgcagtacagtgccaggggagaacaaggtccccttctccaagacccctcacaatcacagaggctgcctgcctgttggggtaccggtgcagacgttccctactatacccagcactgtgattgtgtttctgctgtgagaaacgacccaccagcagaaaggtctggaacccaagggctgttgtccagattcttttgtcccacggggtgatcccttcatatggttccctccctcttcccatagagttggcatttcctaagagccagactgcaggattattgctcttctggatctagccacgcattggggctactaggctctgggctggtgctggggaatgcctgcaaagagtcctgtgatgggacccatttcaagtctccaagccatggatacaggcacctgctctgctagaggttgcaggggagtgatgtagactctgaaaatcatcagtgagaatccttggttgtagatatgttcactgtgctgactttctcaaatcctgtttatactagcagtgaagttgtcatgtgaacagatttgggacctctgattagccaggatgttgcaggcagtgggattagctgttgttttcaccttcctgggagcagagttattctgtcatgaattgctgtaatggcctgaattggtaggcctccataaaggaggtggtcctttcaacagagcaccagctgtggtagtagtaatgggatacaagcttgccttacattggccagggggaggtattctggtttctcaggtaatgggtgaggccagaaagctcccaagagtttaagtcttttgtgtttggcaaccagagtggatagagaaatatcaggtaggggcaggattatgtgggtctgagctcagactgtccttgggcagggcttgctgaggccactgtaggggtttagggagtggttctcagttttctggggtaatgttccagaggggagtatggctgcctctgctgtgcagtatagtttgccagggaagttgggggtagcaggtagtgaaaggcctcacccagctcccacacagttggcaagcctggtcttgctccctcagtatcctattaacagctccgagtttagatctgggcagcctgcacataaaactcagaacagccccaggccataagcttcaatgctgagaaagcaagtggggcttttaggccacatctctcccaatttgtccacaataccaacttctgcactcaaatctgcaacagttcccttttacccctggattctgctcaggcaggttcatgcccaatcaatattactacaaaatttagtttgaagctgctttcaccctgtgacccctacttaattgtgctggctgcctttcctgagggcccctgtgagatatagtcagggatggcttccctgggtgcaagctggagaatgggagtgcctataaggctcttcctgctgctacttctacatttatgttttgtgtgactccctaaatcctttccagctctaggtaagtttaaatccttctccagtgatctggattttcagattccccagtgggatatgttaggaggcagatttttcccctctcacactttgggaactcacagtttttcgcctgtctcatagaatttgtagcagcatgccgcttctttcagaatatctgtgaattctctgttttcccggtacactcctgcaatggtttttggaacaaaagttcatggtctgagtctccacacaatcttctttcattccaggtgggaaatgcacattagtcctgcctcctatccaacatcttcctcctgtctcctgtatgtcctcttttgaaaaatgtctgtttggagcttttgtccattttaaagaatcatgttagatttttttccatagagtgatttgatctccttatagatgaatggattaaaaaaaagacccaataatctgttgcctatgagaaacacacttcacctataaagttacaaacagactgacaataaaggaatggaaaaagatatttcatgctaaaagaaaccaaaaaagagcaagaataacaatacttatatgagacaaaatatatttcaggacaaaaactatcagaaaagacaaagaagtgcattatataatgaaaaagtggtcaactcagcaagaggatataacaattttaaatacttatccacccaacactggagcacccagatatatgaagcaaatattactagtgctaaggagagagatagactctgatacaaaaataatagagacttcaacaccccactttcagcattggacagatcttccaggaagaaaatcaacaacaacaaaaatcggacttcaccttcattataggccaagtggacctaatagatatttacagaacatttcatccaacaactgcagaatacacattcttttcctcagcacatggatcattctcagtgataaatcatatgtgaggtcacaaaacaagtcttcaacattcaaacattgaaataatattaagcatcttttctgatcataatgtaataaaactagaaatcaataataggaattttggaaactatgcaaacacatagaaattaaataatatgctcttgaacaaccagtgaatcaatgaataaattaagaataaaattgaaaagtttcttgaaaccaatgaaaatggaaatacaacataccaaaacttatgggatacaataaaagcagtactaagatggaagtttatagctctaagtgcctaaatcagaaaagaagaaagaccaaataagcaacctaacaatgcatcttaaagaactagaaaggcaaaagcaaaccaaacccaaaattagtagaagaaataataaagattacagcagaaataaataaaattgaaatgaagaaaataatacaaaagatcaaagaaacaaaaggttgctttttttttttgaaaagttaaacaaaattgaaaaagctttagcaagactaagaaaaaaagagagaaaatccaaatacataaaatcagaggtgataaaggagacatgacaattgatactgtagaaattcaaaggatcattagtggctactatgaacaactatatgctaatcaactggagaatctagtagaaattgaaaaattcccaaatacatacacctaccgagattagaccatgaagaaatacaaaacctgaacagatcaataacaagtgacaagatcaaagccataataagaagcctcacagcaaagaaaagcccaggacacaatagcttcactgcagcattctatcaaacatttacagaactaataccaatcctactgaaactattctgaaaaataagggtggaggaaatacttccaaactcattccacaaggcctgtattaccctgatacttacaccaaagacacatcaaaaaaagaaaactataggccaacaccctgataaatattgatgcaaaagtcctcaacaaaatactagcaacctgaattcaacaacacattgaaaaagatcattcatcatgaccatgtggaatttatcccggggatgcaaggatggttcaacatacacaaatcaatcaatgtgatacatatcaacagaatgaaggacaaaaaccatataataatttcaattgatgctaaaaaaattgataaaattcggcatcccttcatgataaaaactctcaaacagctgggtgtagaaggaacataagccatatatgacagaactgcagctagtgtcatatcgaatggagaaaaactgaaagccttttatctaagatctggaacatgacaaggctgccctctttcaccactgttacttaacatgttattggaagtcctagctagagcaatcagaaaagaggaataataaaggacatccgaatttgaaagaaagaaatgaaattatccttgtttgcacatgatacaatcttatatttggaaaagtctaaagaagtgaaagatatctacaatgaaaactataagacattgacgaaagaaattgaagaggacacaaaaaatggaaagatattccatgtccattgtttggaagaatcaatattattaaaatgtccatattatccaaagcaatctacagattcaaagcaaaccatatcaaaataccaaggtcattcttcatggaaatagaaaacacaatcctaaattttatatggaaccataaagactcagaatagccaaagctatcctaagcaaaatgtacaaacctggaggaataacattacctgacttcaaattctactacagagctatagcaaccaaaagagtttgtttctagcataaaaacatattatgttccaatgaaacataatagagaacacagaaacaaatccatatatctacagtaaactcgttttcaacaaaggggccaaaaactttgaggaaaagataatctgttcaataaatggtcctagaaaaactgggtatcaatatgccaaagaatgaaactagattcctatgctttccataggcaaaactcaaatccaaatgaattaaatatttaaatctaagacctcaaagtatgaaactactaaaagaaaatactgaagaaactcccaggacattggagtgggcaaggctttcttgagtaataccccacaagcacaggcaaccaaagcaaaaatggatgaatgggatcacatcaagttaaaaagcttctgaacaagcaaggaaacaatcaataaggtgaagagacaacctacagactgggagaaaatatttgcaaggtacctatctgacaagagatttttattatttgctcagacaattgttgccatgcaaatatagtactatttatcccatttctccgctgccatttctgatagcatttcaagtcacatcctcatagtaattgacaatcttagtttatgaactagagccttcctccacactgactttttcaacatcttgcatttcatcaatattcttgatcttctcattttcagtaaataatactaatacatcagttaagttcttgcatgaccacatcctgtcttttccaaaaactataccagtggcaatgacaaatgtggccagttcactttctgactccacatatccatgcaactgcttcagtatcatcattccaccagttctttgtcttctttaatctctggtgcctggtatgcctctgcattttcctagcattcatctctgctgtcatacctttcatcactattcacccttagatctcatgattctgtcctgcaatgtcttgtctgattactttctgtgtccctgtttggggaaaaaaaaaaccctccattccttggtgaatgtaagtcataggtctgactcctctcatgtctagtcacaggctgctaagcactcctgcaaaattcagacaacctgacattattataaattcataacctgaaatctcaattagatttattagcaatgtctaacaattctctgagccaccccatttccctgtttttcacaattccattctaaatcttctctgaacacttcaaactattgactctatttttctttcactgactttagctagctttactgtacagagaataaataaacgtttacatataaagtcatttaaatttcttctaccaaatgcaagaatccatcttcttttcaatactcctttcctcccaacatccttcttttccagtaccattgaagaggtgtctcttatcttatgtaatgataatttatcttgcttagctctgagtggcttgcaccaatatatatccagaaatgaaaagagcagttaaatttggtcaactgtcctccttcctgaccaaataaccatgccttctgatatagtgtgtttagtgtattgaaaatatatatatatatatttgtcaaataattgttgactgttgttattggcaaatataaaataatgcttccaaaatacataacttttttttttacctataatcacaattgttttctccataactgctatgcaattatcaagtataaaaaagtaaaaacctttcacatgttgggtatcttttcgtaagtcaaacaaaaagaactaaaatatcaaactgagtttccctaactttgaatgatgtttaaacttcttataagagtaaaatgattgattaattacttttcttatttcaactctttcatgctttactcttcaggtgacttattcaatacatttcttttctttaactacaacttagctatagatttttaaattcatctctagaaatcaatgtatttttggcaggtagaaccatactaatacatgtgcttgatataaatgatgctgagtctcacatgcaacaaaaatatatttttaaatatagctttggtcattctttatattcgagtaagttgtatagtcctaccctatctcctttggagaaacatgtaaatacatggagttgttaatattataatacaaatacatttatggcagtgtttgctcaaaactctcagtgccttgtaattacttaaaagtataataatcaaatcccctataatgatggttataattccaaagcattttttgttctaagacactattttagacttttactggtctattcattcatttaaaaaatatataattaatctactggtctaaatttggccctgaaaatgcctatcatatttccactattctaaacacccattctcattctgcttaggttttagggtgtagagtaaatgccaatgtatgcatgaattcttctttattccattagatatttaattttgttctcttcttcctctatgcttccattgaactttgttgtagtttattacagcactgagaatatccttttgtttctactataattatttacatatatacatatcaaatgtacattttccttgaaggcaagagtcatgcttcattcatctttcttatgctttgtttaatatatatatacataatatattcccattggatgaaaatattattactgtttaaaaggcttgcctctaggcttaatttaattagcattttttctattatatttaagtgattctctatataatactaatagttgacagaactagaaggaagactatatgatggaagatctgatacattttgcctatttaaggagatattgtcaattaaagaggaattagttatgtaaaccttctctcaattcccaatatatgacaaaaggaaacttcttggtttatgtagattttaatcaaatttggagtaattagtacccattaattttgtatcatatcatttaggatacatttttgccatagaactgtatagtgaactatgattattatttgagagtatccagaagtaggctgtagtacaaaataaatagagtggaacaaccagtatagatttttgtgatgaaaaacacagaagtgctattgtcttccttacttcattttcttcctttcttccctcccaccctcccttctttcgcttattccctgctttcttccttcctccctgtctaaattaagagatttttagcgttgttggagtttcttcccttcctcttagtaccctttagattgctaataagaaaagtctaagaacaaaatattacccatccaagataaatctttccaataaatgtgattcataaacctgggatgggaacaaaggcatttaataaggtgaccctcaatgcttcacagcttaatttttattagcacatcagacactaatagactctcatttaggtaggtcaaggggtttttacagataatgtctgtaaaggaaataatgtttccaaataaggggctcctaaagaatatcttattttcctcaatcataaaatgctttccagtaacattcccagttgaattggatgtcaagtatttagagtgaaaatttctttgcatttcttttcattaaaatggactgtcataaaacaacaagtacggcacctcgcataaaatcaggtcatgttttatgaatatttaacttcctttgaacttttcagaaggaaacagtgaccttgaaaacttctagtagcagtacaacattgtaacacaaaggccactgcctctgtcattaatcatggtagatgactgcctagagctggtgttggcttttcaaagagaaataataaaagatagaaaaatgtgaaaatatttattatacactattttatcatttaaaaaaaagggaatagttgagacccaactagcacatgaaggtttttttgaaacttatttttaacatggagtttgaaatttttggttttcagttactgtcagcttgaaatcaatatactagtcaagcaataagaatttaataactgctaaatattggttcagtatattacctttttattgggctttggaactttgatttatgcagaatcacgacagtactaaccctaaataagcaggcctttggtgtgtgtgtgtgtgtatgtttgtgtgtgtgtgtgtttaactgtttatgaaggtttcagaaaggcattcaaaattctcaggagaaaaccagtaaaataaacaaatatttatccacatgttaattcaagtcttatttctagaacagaatattgacttggagctatcatctaagccaagataaaaattttcagagtcaaacagaatgagtgagaacatcattatatttaaatttaaataatattaaaaaggaaaacagacaatttgatcccttggtctttagtaaaagcaatattcaaaattataatgctttttctagatttttaaaaaataaagtatacacgaatcatgtaatttgctcactcatataatattataccaaaattacctcctatgaacaatattgcatttgtttcaattaaaccctcaggattataaatgtaggtatttcatatttttatgctattctagttttatatcttcaaaataacaaatagccaataaaatttccatggaaaatgttaactcttttttccccagcctcttactttgatgtcatcaataatgtctagatcatctattgacagatattaagcacagcacagtggaaagataacaaattttgtaatcagaaagatgtaggttcaaattatctgtatctgcactatacaatacatagccagtagccacatgcgctccttgaacagttgaaatgtatttagttcaactgagggattgaatttttaattaagtaaatttaaattttaaaattcaaaacatatatagtatttcattattttgaaaggactaagtttcattttaactatttacattacataagtattcatgctgcattgtaatacacattaggctcatgtttcatttctatggttttgtatatatacacataactgatctattggggcgagtggattgactcagtttgaatgacttttacatgtactatgtaacactgcaatgtgttgatttgaacattttatgcagaaggcacagttactgttacctatataaaacataattggtaaatacaggcattctttgttttattgtgcttcactttattattttatcttattttatttatttattttttgagaaagggtctcactctgtcacctttcacccaggctggagtgcagtggcatgatcacagctcactgcagcctccacctcctggggctcaagtgatctttccacctcagactctcgagtatgtgggactacaggtgcatgccaccatgcccagccagccaattgttttatttttgtagaaacagagtttcaccatgttgcccaggctggtctcaaactctgagcttcaagcaatcctcccacttcaacctcccaaattatttctgtgattatagtgcaaagccactaagcctggcctgcgctttactttcttgcactttacagatattgtggttgttacaaattgaaggtttgctgcaaccctgtgtggagcaagtctatcagcataattattccaacagcatgtgcccacttcatgtttctgagtcacattttgataatcctcacagtatttcaaatgttgtcatcattattatatctcttatggtgatctgtgatcagtgatctttgatattactattataattgttttggggtaccacaaactgtgcccttgtaagatggtggatttaatcaatatatgctgtgtgtgttctgactgatccactcactggccattccctgtctctctctctctcttcaggcctccctattccttgagaccaacgatactgaaattagtccaactaagaaccctctaatggcctgtagtgaaaagaaaaatcacatgtctctcactttaaatcaaaagctagaaatgattaagcttagttgaggaaggcatgttgcaagccaagatgggccaaaagctaggtcttctgtgccaaacagctcgacaaatagtgaatgcaaaggaaaagttattgaaagaaattaaaagtgctactccagtgagtgcatgaatactagaaaagcaaatctttattgctaatatgaagaaagttttaatggtctagatggaagatccaggatccaagatagaacaggtgaggaagctgcaggacaaaagtatggaggtagcagagattggttcattaaatttaaggaataagccatctccctaacagaaaagtgcaaagtatagcgggaagggctgatgtagaagctatagcagattacccagaagatctagctagaataattgatgaaggtggctacacactaaacagcagattctcaatgaagatgcaagattgtattggaagaagtggccatctaggattttcacagctagcaaggagaatttcatagctagcaagaatttactactgatatattatatagtgatgatatagaaactaccaaaataataaagatgaaaagagattgggagtagttacatcacaaaattcatgatgaattgcaatttattgtggtagtgcgaaatgaaaaaaaaagtataaaaacttcaaaaaaatataaagttgacagtattaggaaacatcttcagcaaatatggaatgaattttataagaagttacctttgagaaaagaattgataaaattgattgtctggaatctgaattaaatgctaataaaaacatttaaacaattttatacaaattctgagtttataaatttggccaaatgtaagataggttggattcctacacaaaagaaatttagttttagattgagatagtaagataaattattactcctgatatggaaattttgttatgaaattgctaaaaataaaagacaatgattttaattatctgtgttcttttttaacggtcattggttgattttcacaaatttttactgtactcaacttcaattcatgattttctttaaacaaaaggaatgtttgccaaacatgtaattatcaaagacaaaaaaatgcagtgtgtttatatttttcactgataccacactgcatatgaatgaacaaaatctgaagttctatggaaaaagaaagctcattagtacttagaaatgtaaaagtattttaaagctgacatttcaaaataaaaataataattttacacatttttctaacatgaatcaatatgtagattctactctttgatgttatataaatcagattcaaagtctaaaagaaaatgtctaagaaatgtctttttctaatatttgaacatttagagttgctttttaatttatacagtgatattttaaactagatattaattggcacaatggctagtgaagaaaagatgaatttgttctgtcaatatatatgcaaagatgggaagaaatggtcttttttcaattattgaaaatctttttgaccatatttggaacaatctatataagggaatctattttttgaactgtaaacttcattaaatgtcaatacagatgaagcaattcttatgaaactaagtgtaaaatacctacaaatttcaaagacttagtatgaaaatattgtgtgaaatatttcattaataatttttatgtgattacatgttaaaacgttaatttttataatatactaggttaaatgaaatatacaattaatattgatttaacctcaaatggctacataaaaatttgattacatatgtggctgacactatcgaatactgatctatatggtcttgtacaagctacaaattccctcacaatttcattttctatactttaaaagtagaatcactccagatagtgtgtgattagggtaaccctgaagtggtcttaggccaattgtttctggaaagtatttcctcatttctctaaatggaactaaatagtacatcactgttcaaaaagtgtttggtttttacttctgtaatagaaatatcatgcttatcacaagcattcatccctagtggctgtgactccaaaggaaaacaaaagaacatgtaagagaaaaagaaaacaggaaaagaaaaatattcaaacaattataagtgatttactgactagttctatgaactctagcatggtggctgggacacagtaggtgttttatgatttttatagaattaatatttgtgtgatgctctagaagaccaagccctataggtaacagtgcaataatggttagctaatttacattggtaaatttaaatatggaaaaagtgagtgctaataacccttattaggtatatatgtgtatgctatgtttatgtgtgtatgtcgaactcagttcacttttgctacagcaatcctgtaatacaggtattaatattcacattttactcaaaataaaactcttacagataaaactttccaaggtcactaagcaaatatgagaaacaatgtagattttaactaaatgttactaattaccattccaccacattgccataaaaaccaaattatttgagccatgttacatatttaggtaaattttataaaatgcaaatatttcacctatctaatctaatcgagaaaaaccacaatagctctggtttacaaaataaatatgatacctattttcttaaaggtaatgttattcttatgaatcctgcggcatgtcaagcaaccggggtagcatgaggtacctagtatccttcttggctggggtcaaaggaatatagtaaaagagtttcaaatatggggtaggccgggcacagtggctcactcctgtaatcccagcactttgggaggctgaggcaggtggatcacctgaggtcaggagtttgagaccagactgaccaacatggcaaaacccgtctctaccaaaaatacaaaaattagccaggtgtggtggtgcacatctgtaatcccagctactcaggaggctgaggcaggagaatcacttgatcccaagaggcagaggttgcagtaagccaagatcgcaccactgtactctagcctgggccacacagctagactctgtctccaaaagaataaaatatgggggacatattttatatattttattttatatattatatatgtatgtatatatgcatattaccgtatttcacacacatacatacacatatataaacataaactttaatgtgtttttataattttttataattttacagcatctggaaatagtttactatagcattatgtaaaataaactcgcagtcttaaaatttcctattgatgacaaacagaggatcactttataaaggagtgtttctgagaagacctacccaagcagtctgaaatgtatgccctcttcctaccccattctgtctccaagctggatgaagaaaaatgcaggaatcatctcaaagattatcatagaaatgccctattgtcttccaagactctgattctttttatgatcccagccatgtatcatgatgacagccgtttctcggccttatgactaagatcaagtgtgtcaccatgacaacttggagaatttcacctgggggagaggatccacaggtagttccctgtaccttataatatctgaaaaatgccaaacaaaaattaagtatgtttactccaactccaccaaattccaatatggtccctgtgcaaatttccataactttaaaaaatggtaatagggaagaatagaaaacaaactccaatggggtacaagatagaaaaaggttttagaataaacttacaagacgtgctccttaaaaaatttattgtcaatagtgctacgcaaatgtataattgtatatatgtgattttaagaatgtgctgcttaaaattaataaaggcctttgtcattgctttgtggctagaaagatgaaatctaaaacactgagttagtctgaggttatctttattgagtggcaaggaagtattaaagaaacattatttctgtaagaatgactgtcatcctttagtacgttgtacctattgcactatctctgccattcgataggcagccaagttctctggctttcaagtcctcagcctcagtgtgaagatgaatctcatttccttgaaatactgctcctgctgtatttcaaggaaatgagattctgttcaagcaagttgaaatcttaattccagttcttttcagagtaataatttatatataaagtaccacagatggatgtttatattagatataataacttgaagacttattttacctgaaaacggaattagagcttcttaatgccaaaatacagaactaaatcatttaaggttatagccccatctttcagtgctggagaagcaccatcttttaccaaaagagcatttaagtcagcattacttctttctcaactgatatcacccataaaaagttttcactgtcacaaaaaccagtaaaggagtaaaatatttggcaactattgggcaagtataagataccttatttttactaatgaactaatgtgaatgaatatgaaagaaagctcatggtattctgtttcatacaatcttatccattacatttgcttaagcaaaaacaacttgaagaaaagtcaatttggtcactaaactttgggagtaaaacacaagcttctcatttataatttgaaagagattaataggtgtcataattatcaaggtgtcgttaagacctatgacactctgaatattgctcatattaaattaagaatcattaaatgttgtgtcagagacttggagggaaaataaaagtaaaaggaacaattacattttattaaataatgctaaagaattatcttaaaattaatatgtaagctctgaagagaatgttatcattgactataatatgggctgatggttgaatatcagtagatatttaattcttatctatgtttctgcacacaaaatttgtctgtataaacacaccccaaaacaaaattttctaactcattcatattgttaaaacctgccttaggtgctctgtggacataaataagaagcagccttttaatgcttgcatgtatcagattattgacatagctattacggctttatcctcaaaccacaactttcagaaatgttgcattagaatgtttttttccaaaaaatagaaatagattaaatttttaccagcataatattaatggtgaagagaaaaaataatgtctcttgcagaaaggtttaaaatttttagtatgatctttaaccatttaatcactgccattttctttagatatcttatttccatttaattttctctttataatctgattggagagatgaaaaattagacatatactgtattcttatagtacatgaaaattgtgaataacccgaagagcttatatatactgaataaatgttaactcttgaacctcctgtaaagtgactacctaggtatgacaagttaacatttctctagtaaaaaagttgcttcagtccccctattactgtcttttaatggcttatcttgtctcttttggaactaaagctgttccaaacaactttattacacacacacggagagagagagagagagagagagatcagacaactctgatttttgagagaaaactatcattgtctagaagtaacattcactatatgtaacctataaaagcacatttgtcaaatgcttgtgttccataacaagaatatattctataaatataaatatcgtagtatttttttctatagtgtagaagggacacttggctatcaggccattttttaaaataaatatctaagaaaacatacttcagagtttctgtggcttatgtagtgtatttctacactaaaaaattagaatgtctggggtttcaaattagatgaaatcacctgccttataaattatgaagatccacagagccattgcttcccaggaaaactggccctcagttatcacagagtttggaaaagtatggcttgtcactagtttttctatggtccatgaactaagaattatttttatattttaaaatagttgaaaaaaaatccaatcatgatatgagaaaactatagaaatcatcaattgtccatgaataaatttggattgaacacagccacagataatcactggcatgtttactatgactgctttcttgctacagtggcagagttgtgtagttgtgacagagattgtataatcctgccctttacacaaaatatctagaccctttagatagaccaaaagaaagttttgcaaagagtacaaaactattagcctaatgagccatttggagacttctgaattatctgtgtatatcctaataacacttttattgcactactaattgctcagggctgccaactcaatgactaacttttaacatacatgattatcagttgaacaatcaaaaattgttttctcagcataaccttatactactgctaaaatcagtgtctagtgagttgtcggggcccaaacaagatgttttaccattctaacaaggcataattctttttaggatatttgctccaaaccatctaagttttattctatatgtaatgtaataagttaatacgacacgtaaaatgccacatccctgactaacctcccctgtgcctgagttctcaaagtgctctgtagcgccctctactgtctgggctgtgtaccaactcagacactttgaggagctggccatagctgggatttcctttttatatattttgtataggtcataggggcaggcaacccataatttaggaacagatctgggtatctattcttccttaaggggagcgtgcgtgcgtgtgtgtgtgtgtgtgtgtgtgtgtgtgtgtgtgtgtgtgtgtgtgtgtgtagtttgggaataaatagaaacatgcaatcttgaaacacaaatgagaatattcagcatatatactgtggttatgtatgaattttctttggcaagtcagactcagtggtgtgatgtgcacacttagtcatcttacatttgccaaagtaatatgagtacacaaactcatgaatttacaagcaagcaaaatgtttccaagtcactttcattttaagaaatgtatatatttgtgtacctgcattgaaacattaaattcagaatatcatgataattatgcaaaaaagagggtagttgtcttacacaatatgacacaaaatgacagaagttgtggattttaggatttggggtacattgccttaggtatcttttggtgcatcaacagtcaagaacatgctttctacactaaaggaaaaggaattttatgtcttcatgctgctaaatttaaagagttgcaaataaatttgtatagaagaattgatgcaaaatatatttattgcaatatgtacaattcctaaactcctgcactaattaaacatcttaatgttatggtgaaaatcatgttactgtcattactattatattactattcaagataacttgccattttcacagtaaaataatttttaagacttttagtgtgtctatggcatgtctatgcctgtccttttttagaacaagtatgcttattacctgatatttcaaaatagtataaagtaagtaaagtaaaaaggactgccttctttaaaatgactcaaaaatttaaaaaacatagaaaacatgtaaagttttcaagaataatagacaagtccataatatcactaagcatgaagaaaaatgtaggcaggacaaagtttcctgaggctaaaatatgaaagaaaccatcacaatttcctaataaatttggactcctcaagccagtaatatcagaataaaaattggcagtggatattatgcctaggaatattcctggcctattactaacacctagaataaaaaggctttagaatctattgattgttataatataactaagtaaaacaatacatttgtgtttaaaacatgcatttcatgtgacaataatttaaaatctttgagacctcctaaagccaggaaaaaggagaatatgacccaatgttaacactatcaaagcaaagtaatacagttgattgaaaatacagttgagcactcccagcagatgaaggtgtgaatttcctcatacatcatcttaatggcaacattttctacaaagcgacatggagcactcctttcatatttcatgagttctatttgcctgacttcaaaatgccaaatgtgccagtgaacagtgctttaatattcatgggtttttgagatggctttgacagttgtcaactagagaaatgacttcatcaggaaagaatctaacttatgatttctggcacacatataaaatcatgtagtcattcgcatatgcattctacttgaaatgtattatttgcatagttatcttttatgaaaattacaaagctataaaatcttttatgtaacagtaagacatttgtaaatcttatttggatatatacttagcatttcagaaaattttgttaaccccagacatttaataattgagttatttttacaaatgtcttttgaaaggacatagcccagtaagtatcccaaaagttctctaaagcataagtcatcacagcataaatcacacatgtatgtgaacaattcatatttatttccctttcataattcaaaagcttattaagtaattcagtttatagaaaaaaaatgcaggctatttctttaacccaaaggtttggattttgggtcttgagtctctcgattacctttcacacactaaaaataaaatgtaaaattacccatgaaatacagttcactgctgttaatcttaaaagttttaggaatttttcacacgatgtcagtaactaataatacattgaataaattatataaatcacacaaagtcataagaatttttagtgtatattatctcattgtattctcccaaaaatcttatgagctggaagaaccaatagcataataccattagattgagagtaatatctaacagttattcgatactcactgttcgtacatgccagtaactcttttaagcactttgtatgtattagttcaattaatttcagtatataattaaccacttttgtagatgagacagattaaataacttgtcccatatttcctcactagaacattgattaggagccaggcagtcatagtcgtatagcctgaactccaacaaaaaccctaaactgtcagatgttaaactacattgagaacccagttgacgtttctaccctagggttgtttccatttatttattacacaaaggttattcttattgactggtatatttaattcattgaatttagccttgaaataatatctcttttggggactattctgtcagcactgaaagttaccctagggataacatgaagttttgaaattaagtgtgatgtgtcatctcttttctttttattcatctttccttgttctttaagttacaagcattcaaagaggcaatagagatatgtgtggaatgatggctggagttccctacattagatgattatacatttcctattggctggcacttggctatggactatatgtatacataaatttaaaaagcctgaaatattaatttttagagcttgctaagataacgggcccagtgccccttactttctgctagtacatgccctgtcacttaacgtgtatcaatacaatagtttatcttctctgtgtttatacatgggttgtttaggataattaaaaaaatcaataaactgctgagactagaactctgagactggagctaacagtattcctgcagaatctccccactgcacagcaatcctcttacattttcctagtcagctcttcctctcattctccatagcatctatttgatctttcttaaaaatatctagtccttttctttcccaccactttgtgcagatggccatgcctactatttcacaggaaaactagatactgtgatgctatacctgctcacataaaaacactaaaaatgccctctacattcctctcttttccttgtccctcctattatgctatcaaagcttaacaattctgtctgtgccctgaatgctgcctcattccacttcctcaaagtcccaactcttgtagttatcttttttatcctctagactttcaaacctttgtatcatttaggatgggacagactatgctgaaataacaaacctcaaactatcttgaaatcatgagcaatattgctatatccacactattactgcccattcaattctcaaaattagtttgtttctgaaagtaaccaccaataacttaactttaaaaaaaaattctagagaccgggagcgttggctcatgcctgtaatcccagcactttgggaggctgaggcaggtggattacctaaggtcaggagtttgagaccagcctggccaacatggtgaaactctgtctctactaaaaaatacaaaaattagctgggagtggtggcacacgcctgtaatcccagctacttgggaggctgaggcaggagaattgtttgcacctgggcgataaggttgcagtgagccgagatcgtgccattgccctccagcgtggctaacagagtgagactctgtctcaaaaaaaaaaacaaaaaaatttagagataattttctcagtcctctcttactcatctattcagccttatttgcaaattctatgcatctcccttgaaacactctttctcttgttttttcctgatatacacacatatttttcctggcattttaattctagacttaactttttaatataatcctaaacatcggtatttgtgagagttttaagtatttttttcttctcttttaaatagattgtcttttcttcaacgcaaggccaatttgctaaagagagtttatatattctatcttccagtttaatatatacacattgtccttgctttgctcagttctgatatatgtaaatttcagtaactattgtttcgttaaataataccaaacccccaacaacaaaattcaaaattcaaattcaaaactgagagtaattatgtgaagtaaatctttgctgctagctctttagtccacaaattaatacattaaataatagatatgcatcacgatccgttaccagccccatcactgtcttcaaagtctgttggtggttggtcaccggtcatttgttattcaattcacaaacagtcagcaaagcctgcagttatgttgcttccttgtctcccagttatgaatccatgtgatatatttttaaatggataagtgaaagagagttggccaagaaagatgaaagagcaacaaggaaatagaaagtgataatgccggaagtgaaattcaaatagaacataaaatggattcatagaagaagtagctggccctgaaaacattggcattggcactgtccaagagaatctagatctttctctgctgagatattcttttttattattcactacaagcgtatttccctgatgccactgggcttggttataacagctgctttataatccttttcgcttcattttgacaccaggatatttcatgatcaggctccactaattgttctatctactgatcatgggtcatatttcttttgttcttcatttcaactaattttgcataatatcattgatattgtgaattttgtattgttgattctgttatattctcccaaggagtgttgacttttttgtttgtttaactggcaattaagtttgtttggtgtaaaccgcaaacttttgtatgtaacccaaaaaaaattttcaatgtggtatattttacattttcagacttcttgatatttgttcttcagcctagaaagtaaagaaaaatgacagaagctgagaagctttttaaagaggaagtcttaaaagtataatgagaaaaataacattctttgatgtccagcagacaaatggtgagggtagaaaactaggttatatatttgtgtattttgccagaagcattggctatattagcagctgtcaccatggggagattcccaccattatgtagcttctctagtaggggacagtcaggaatgagttatggagagaaagcaggaatctacaaaggacagttcataacagtgcagctgcaaaaattttccaagaggaacacatgagacctgagaagtaaaaacagcctctggagactcccagtcaaaagtgcagaagaaaaggggagtggggaatctgcctgagcagatgggcaaaatgtttaaactaaggttaagaagattaaccaatagcataaggttaacatgcaattgtcagtacctataaagggataaacctcaggacaactcattatattaaaatgacttgattgcctctaatgttaacatattttattccagtgtaatttcattaagatgaagttaatttatatgcttactttcgctgtgagaaagacaacttcagggcaaaaaaaaaatttactttgcatttaaatgataaaaatattgcaatccatataaatttgattaaacgaacaaacaaaaatgttagtcctatggaaaacatatgcttatgaaatagtaatttcatcaattatagtgtgcaacatactttgaaagaaacacaaaaacaaggtccctgggatgcctggttttctataacaatggcgcaatggaaatgagaataaaatggagactaaaaatagcatattaataatcattgcactttctggatcacgctatgaaagacattttgtgtatcaataaccaacaatttaaatacttacaaaataaattttagactggtattaaaggtatttatctggaaagatttttctcaactattctaatatttctgtttgttcttatttttttctcagttttactcttttgtaatatgcaaagaactttgtttttttatgccacttttatgctttttactttttgcttcctttttcctaagacttcatttttcatagcatatgttccttttttaaacatcatgtaacagagttaccctctttcagatgctccaaaataaatacttgtgagaaaaacaatttgcttactggttcaatttctaccatgccattaatgatgactaataattataaaaataataactgactattgatggtctaatatgttatttgaatacatcattttgattaattcttacgatgacgcttcaacatgaaaacagtatcttcaatttacagctgataaaattgatacttaaagaggctaactgatttttcaaggttaggtgacaaactggaagagccaggattccaactgcaattcccattgtttctttgcatgcattgctttcacactttgatcataattatttgttattatcttagaataattaaactattaatgtcatatatctattgatgacttgcaactgcacaatataattctgtacaagacaattataatacctacaatatcatttgtcttaattggttgagtgttattacatattatattgctgatacaacaataattttcattgtttatacaatcatttataaagaacttaactaaatagttcacaatggcattattaaaagttctgagggatgaaaggaaaattgaagcctaatgtctaattgtttttttattttagattgctaatcacagccatctcataattttacatgatgttgatgattgcatgagttgggaacattttctatttggtttattgatccctatgaatcagaactttgacactcacaatagcaaggaaagtggtttacttaaaatggcgttattctttgcatggagtttgctctttttcaaaggcagcattttaccttttctttgaaatcatcttattgctgagtgttttaacattcagtgggcaacaagctatcaattatattaagaaaaaattctacatgctgatctaatgcagtcattgagaatattttaaaacatatttaaaattagaaattttaagctgaatctgaaagactgttcattgtgaaccttagcataaataatttacagacatttgtaatccactgctagaggaattcaacagtacagacctgtgattatatcctaaatatcttagtccgtttaggcaaaatgacagagcatctgaaatgatttaaaggcttttttatgattaacaaaactataattgcctacattagaactatttcattaaataaacacattgattacttatggtatgcctggccctttgctacaggtgtactttgtataacttgatagtagcaaggagtaattataaagtgtcacaggtgtaagtgtggtggatgaaagacggccgcaaatacattagcactcttctcattgagatgtgaagtttttgtatcctctccttgactctggtctagcccgtgagtacttccacaaataaaatgcagtggaaaatgaggttatgccatttccaagtttagctttaaagaggactggcagttgacagattctttctcttggattactcaactccagttaagaaatataactattgtactgtaaaaagccaagactgacctcttggaaagccacttgaaaaggtcatgtgtagaaagcaaggggtattcagccaccttccagctgctccagtcctcagccattcaattaatagcactgataccctgaacattttaggtaaagacacattttctccagtatgccctattccaactcttaatcccaaaacaatgaagtataataataacaaattttgctttaagccctatgagttttggtaaactctgctactaattgaatttgtgatattggaaattttatttaaactatttacacctgcaattgtaagtaaataaaatgatagtgcctatcacattgttatgactaatgagatactgaccttgatgtttctaaactgtatatggcacataaaaataagcctttaactccataacttgtatttccagcctagacttctcttatgagacccagacataatcatatatccaattgctcattaagcaagtctacttaaacgttttatagcacttcaaacttgtatattcaaacttttcatattccctcacaagctgctcccttttctgtgttccctattttggcatatggcaccccgtctatttagtttcacaagcgaaatcctcagttatctttgatggtttctttttattatctggaaaaatctgctttttttaaaaaaaatatacaaaacaactcaaaaatgttttcacttcttctcccactgctgccaccttccttaactcatctctctctttctttctgtctttctctgactattctgatagccaactcatgtcactcagacttctgctcactgattacatcaacttttggcactgctccaagtttttaccttgttctatccgagcaatctttaacagtaaaaaaaaaaaaaaaaaaaaaaaaaaaggtaattattgtgatgcataaaactattcaatgaattcaatagaaaacaatttaaaatttgaaacacagtgttacagactctccaaaatctggcttttggcacctttccagactgataatgagtcaccgtctttgttggtcattacctttcagccacacaacactttggcctattttaaaaatatgtcccgccctttctcatcatcagggctttgcaaagcttgtttccttctgcgcacactctcactgagttaactagcaattattttggcttttgtacaatcatttcttcctcaggagaatgctctctgacaaactcggctttgattaaaatctctgaaatgtaatctctttatacagtatcttcttcataaagttcatataattcaaatggattccttttgtgtgtgtgtttttattattaccattcgtattatttaaggccatggcacagagagggttaaaagtggaaaccagcaattaaaggtagggaaaactgataagatatgatacaagcttcaatattggaagaggccagactttattaaaagatggtcacatttctcagcactgtgagctatggatcatatgcatttatttactcacatgtatacacacatgtgcgtgtgcatatatgaatacataatgatatataaccacagctatactttttcatcttttaaaggttttatttataggattagaatacgggttacaaatgttaaataaatagaacagttactagtttccacaaacatttgtttagtgtataaatattccaggaaaatttctggaaatacaggaaatagtattatctaacataaggcaaagtgttctctacctactctttgttgaagattttcaccaaatactagtaaagttttaaatgcaaagatatcttcaattttgaaaggtatggcctttcagccatgattacaagcaggcccttatttcattttctgttccatttaaatgttcgctttaaatgtcacaagtttatggcatgcatattaaatagagaaatataactattctctgtagacatgagagtaagctttaaagagatttgttagtctactttaaaccagaatcacaacctctgtattaggaaacagtgtaaggaaggaaaaagatgaagatgaaagttgagcttcccacttagctcttaggagtttggttaagatctctaggatcttaaccaaaacattcagattctccatgcacaaaattaagaggtaagaaaaggtcaattcttagtctcacccaattttaacattctaccatattttagttactcagtcgcctaaaattccttctgggcacttcctattaatacaaagtcactattgataaaatggtcatatattgactattgttatccattgaacattaaaataatattaggttggtgcaaaagtaattgtggttgttgccattacgaatgcccttataaatacatggcactttaaagagaaattgaaaaatgcgtactatcatttgtttatatttttggtgttatatttccagcatgtagtgagaagcattaagaaaacagaattctagcttaccccgagaatgtcaattttatcttcagatatatgcctttcacatagagaaaaatcaacagacttagggaaacaaaaatgaaagtaacatcaggccaccaaagttctataatgattatattgtactactattcaacaaattgtattctaatatatgcctgtaaatgctgagaagtgtcacaattgtataacactgggaaagagatgattttaattttgcttttttcattgtaattgatttattagactctctagagttattaatcctttgtaatagagtttaaacaattgtaacctcagacacttgcctttgaaattgtgataatttcaaataataaggcatacccagaaaactttgtttgcatgacttaaaatatctatttgagctacagaattacataagccttcttcttttctataaagtatcaagatctacaaaattatatttcaattactttttctatacaatatatttcagtgggtgcacatagatagttattggatgaaaaaaatgtaaaacccatgtcaagtatgccagcctgtgctgtgtatcaccaactgtaatttaaatgtggctattttattcttatataattttggcttttcattgttcatgatatatactaattagctgacattttaccttcatttaatatattctttttgatatcatacaaaaactttcagtgtttgattagaatatgcttgaaacaatgtttaatctgccatactttctttcatcttcactgtaatacagtagagcactgtgcgcctaagagacaagcttatataaggccagctttggctttgtacagtggagcaggtgggtctgaattctattctaatgcaaaaggagctccacaaaatttgtccatatttacgtggaaaaatataacctgttaattgcagtgtttgagaatttatatatttaaaaatcaatataaaatttccctaaagtcttctcagtttttgctaatttaatttaaaaacaatatcataaacattataagtcaggttctgacattttgagatttttttaaagggtcaaatgcctgatttaaaaataatttcatgttcaacatagtattaaatgctttccaaacactccatacatactttggtatttatagaaaaagggctattatgtgagatgcaaaactactgttcctttttaggcatgtgaactgatatttcatgttttctttaatagaaaatatctccatatttataggcagttcataaaccaagtgtaggtcatttggaaattcacattaaagtttaattattgcacactgtacaatagaactaaaaaaaaaaaagaaaaaagaaaaactaaacaaattcctcccatgtaactgagatatggtacactttgaccatcttgtcctcattcccctggtcacgcctctgtctctgtaatcactattgtactctctgcttctatgagtttgattgttttagattgtttagatgtaagtgagaacttgtgctgtctgtcttattgtgccagcttatctcatttagtataatgttctgcaataccatccatgtcttgcaaatagcataattttcttcttttttaaggcagaatactatttcatagtgtatatataccacatttttataatcatttcattcattgatggacatttgattccataattgattgagttgatttcaatcaattgaattgattgattgcataattgagttgattccacaacttggctgttgtggatgatgttgcaataaacatgggattgcagatatttctttgatatattgattttaaatcttttgggcacgtacccagaagtgagcttgttaaatcatatggtaattcaaattttagtttattattattatactttaagttctggggtacatgtgcacaacgtacaggtttgttacataggtatacatgtgtcatgttggtttgctgcacccatcaactcgtcattaacattaggtatttctgaggaaattccatatagtttcccgtgagatctgtactagtttacattttcactagttgtatacaagtgttcccttttcccagcatttcactgacccttgttatcttttgtcttttttataaaacccagtctgacaggtgtgagatgatctctcttcatggttttaatttacatttttcaaatgatcaaccatgttgagcattttaaaaatagatctgctggccatttggatatcttcttctgaggaatgtctattcaggccccttgtcatattaaaattgtgtttcttgtttctttgctgttgagttatgtgagtttcttatatatcttgtatgattaccccttatcaaatgtatggctaaaatattttctcccaatctttagattgtctctttactctgttaattattttctttgcagtgcagaagcttttcggtttgatgtaatttcctttgtctatttttgcttttattgcaaccccgaccatctactttgtgttatgtatttactttgtcaaacatgacatctaatcatgccattttttcagagacattgagacgtcaaggggatgaggttctatattctgagattttctttgagaaaactcccattcattcttatgaaataaaggagaaaatgattggttattgaaacaaactaacctgctgaaaatgaacgtctgttttcctttgaaacttgcgctcacttcctttaattgacccaattgctgccactttggcctccggacgctccccgcagctctgtattgattccctgggaaggttgcattgaggcagcggctctcaaacctaatttttccattcagttttactttctattagttgaaacagacaacaccatctcctcactaaagatatatgctacggaagtatacaaacaggttctggagcctagggcattcattaaaatagaaataccgtaaacatttattatatcagaaatgggagactgcacaccactgaccaaacaacagatgtgtcaaaatgatgcattagttgaattttgccgtgctttcctcttccttttccacctgagaacaaagcaatgtaccagttagaaaaagtaaaataaaataaaatcagcgactgagttgcagagtaaatgatatcaaaactctctgcagatttaataaaagtaaattactagaggtcattacttttcatgtttattgatttttgcagtcaatatcattattaactagtggagaaaaagatttatcatgaagttccaaaatacagagttaaaggaaggagaaagttcagttagttctctatttaaggaaacattatactcacgagctattatcaaaaaaacaaagaattgatagtcaatgttttttaaaaaaagttttctacagtcatgaaaaggtatagattgtgtaaaagaaggttgtgtttatttttaaaaattaatattattattgtgttaatataaaaattttaaatgaagcaagaatgagtaaaacattttttccacttgagtataccaatttatattttctagtattgctcttcagtttcctgaagccctctgacaacctaatagcagtgttactaataacatcgcaaactctttgtgtaaactccacaaagacaggaaccttgtttatctttctcttatcttcacagtgcctggcatatcatagaaactcaataaatattcttgaatgaaggaagaaccagcaagtttcaaagtaattttgaagggactaggtcatcaactgagtggaataacttgggtgaactgactactgcctcagaacaataacattttgctataatatcccattactatgctaatgtttcagtgcaaaagaagcacagaagaagagaccaaactccatgaacttaaaaaaagggatttatagatacagaatacccagaagccaaaacttacactttctgatatgtccagaactattttgggttaaatttttgatactattcctgcatctctgaagcaaaactcataagcacagctatttgaataaaatatctgctaatctaagccattttccctcagtcaccacagaaggctgtaatcatagatgctactatgagtcaatgattccttcaaatggtttagttatcaataaaaccatcaaatggaccatttcccatgaacttggatgaaaagtattatgtagattatattatgtgatgttaaaatattattttcatgaactaaaattcaccttaaatgtaactacttaaaatttgtacattttgaaataataaccaatctgttttaaaatttcccactgaaaagtttttcattttttattttattttattttattttattttgtcacactatgagaggcattcttgcagccccatgccaagcactaactgcatgcagagcacaatgctccaatttgcatcttccaaaaaaagacagctcaaccagacttaatgtattttggctggaaatttgtatgcttagtctctgcccaacatactttagtttgaaagagccaagctataaagcctagaatgatagtttataataggaagcttgatagagttgtttccactgatattttatcagctccagcagtaacgcaatttgtttcttagagagatgggagtgttccttgtggacagaaaaataatggtgggttttacaatgattattttggagaagtcatcttttctacctttctgcaaatgctatagtatctttaggttattttataatttgtgtataatcataaattatatatttctttgtgggtctagtttgatttgtaaaatactgagacttcatgaaataaaaatttttttttatagaaagcattcacaagaagtaaacttcagttaactttgttctccttattagaaactttccctgcatacacttgcatggagggagattagtgaacaaaaagaaacagtagagagcttttgcccatttcttatctttattaaactcctgcccacatgccattagattatcctttttaccttttataaaatagtaattgtcaattactttacacttccttttatatttatctcttttggatattcttacttaaattattaaatagaaaatgtagtttatcagtaacaagccatataatcatagaattgcacatagaagttgtgccagctacaatatcacgggtggaaagattgatttctattttacgtggcttctcaagaccacgtttattctcaaatgtagaaaatgtactcttgccaagtcaaggtaatgtaagtatttctaataaaaaatgcaggctcagcctggcgcagcggctcatgcctgtaatcccagcactttgggaggccaaggcaggtggatcacctgaggtcaggagtttgagaccaacttggccaacatggtggaaccccgtctctactaaaaatacaaaagttagcctggcatggtggcaggtgcctgtaatcccagctactcaggaggctgaggtaggagaattgcttgaacccaggaggcagaggttgcagtgagctgagatcgcaccattgcactacagccagggtgacaagagcaaaactctgtctaaaaagaaaaagaagaaggaaaaagaaaaaaaaaatgcaggctctgtggagtaaattctcagtcaaatataggtatttttcccacttttactctccttcattttctggctggcaggctggactttagtagtggtaactttggttttattccctcagaatcagtccctgagcctatgatgttatcaaactaaactggcgtaggctcaccgggccaaggtttgcagcaggagaaaggaaggcatttatttgcagggcaccaagaaaggagaatcaggcggttcaggctttagtcccaacttccccaatggcttgaagatgagggttttttaagagcaagtgtaaatttcaggaaggcagaagttacaggcaaaatcatagatcaatacatagaggttacacagtgtttggcctaaggtcatatttagatttaaagttcttctgatttgcagttggttaaaaaagagaagctttgtttaaaaatttggggtgggcagaaaagaactttagcttgtggctcctggatgtggcttcctccaggcccttcaggaaaaaatgtagaacaaagaacataagtggtcagagtttagtccttagcacccctttatctgaggtctatgtgccagtggacccatttggtgtggatccaggtttcagcaaaacaattcagggacgttagttatctttagtttctaacttccttgcctattattttgagctattatcaccttcttgcttatcaaattccttatatacttctccaggctagctaggtccctggaagaaactcaagatttttctttaattctatgtttgggtgggcctacaggccaagaggggtccctgctccctctcaatgattcaagtgagaataatttatctgggaaatgaacttaggaaatactgggaaagcaatgaggaaaaaagaaggaacgctagctaagaaagtatggttatcatcagggtcactaatgtgtataatgaatttattcttgctggggtattcttggaatttgtaacaaggcacctcataagtttcctcctgaaacctaagggtaggagtatttatgatgcactgtcatcaaccttggcaaaggcagagtgttagtgaagcaggagagttccctgacccccctacaggatgtgtgacaggggtgtggcttgtgtgttcagcaccatgcacttaaatcccttataggaaggggagcatggagacgggcaggtgcaggagctgaggtgagtgctttggggctccatccccatggtaacatgtaggggtgggtacctatgatttccaaagcccaagtgggcgtgtattacagtgcgttcttttagctttgctgtccacagatggcttaagtgttaaccagctcagtgccctcttgatacccaggtccttgtctggaatccaggaagaatcaggtcacacatggacttgaaggataaatgcagggattttattaagtggttgcattggctctcagtgggatggagggggagctggaatggggatggggtgggaaggtgatcttcccctgcagtttggccacccagtggctgatctcctctctgatcatccccagccagactcctttcagcattcagacgttccttttcttcttgccttctctaccacactgttctgccatttttcttctcttctgttcatctcctcataggttctgtagcatggggtctgaagtttatatgggcacaggataggggagcatggcgggccaaaaggcaacttttgggcatgaaaataggaatgcctgttcccacttagggccatgggtttccaggcttgcaggtagggcctctgccagggaaccaccctcttgtactcagtatttccctgtctcctgtccatatcattagttttctgacaccttgggaactgacaaagcaaataaaggctttgggccaaagggtgtatagagtcaacctttccagcattgacagggctctggggctaccctctctgcctccagcctctcccttatcagcactgtcatacagcttaatatggtgatcctgactcctctgcagccttctaggagatgaaatattgcctttaaacttttattttactaataggtcattttcactttacaagtgtattcacctatgactgctgagatattaaaaaacaaaaaactggactctgaaaaaagagtcctcacatataatttgagaagcactgccttagagggcttctagctctgttcttatatcccggtcatggaaatggaacattcacagttttatattatttcagtagagcctcaaggcagagaggatacaggacatgtaccacacttcccagggaagagctcgggtatattgtgagcttatttagagatgggcttgaacacgcccttgaagacctatgcacaccttcacatccttcatagtaaccacaagctccagatgggctgtttaccccaacccattcaccagccagatgagagccaagttcagagccggagctggccaccagaggaatccaagcattagtgcagaccacggagtgcatgagctggtttaccaggtaaccggtaaaaagcaaacggctgcagtgcagaccaagacaagatagggtggttcgtctcatggacgcttgttgttgaatcaggactttagggtcacgtagtctcaccatcatctctttcttttgtgatcacttttgcccagggtagacaaggttagctttgctatcactttgtatttggaattgattcaacctgacttcctacagagttttaagctttgatatttgaagtcaaacttttgatattcagaaaaccttttttctcatgaacttttcctatataactgtctctactagcataaacatacatacatattcacacacactctctcacacacacaattgtatttgccttaaaaaacaaaaaacaaaaaaactaagttatacttgccctttctcttcaaaacaatagttacatgaagttgtggttgctgcctgaatgtcaggggaaaaggaatgagcaccaggcagcacaatgaaagaaaccttactatgtaaaataatattcaagacttatgcagtgacatgtaaataggacaaaaataaaatacaaataaatacaactaaggctgattttaagataaatgaactcacgtctaattaccattttcattagatacctaaacatatttttacctggaataagaatcagaataccaaattttagtgatgagaattttgtaatttctgaatcatattttatgtgaaaagctttttgaggatttctttgtaaccagacatggtgtttttttaaaaaaaacacaataatacaggggatcaacagaccaagcaggtgctatccccagtcattatagtcaacttaataaatactctgcacacagacatccaaaacctatgagcattgatccaaaagaaaaatcattaaggtgaggatagaggtagccattctcctgaaagctgcttcctttagtgcctgtggtgttggcatgaatagctcaaagctgtctggaattaattcttttctaaagggactgctgaaaaagacaggaacatgtgttcttggcagagaaacaaagggttttaaagtacttcagtatttatcccactacaagcgaacttagtgcattatattaatatcacaattgtccctctacaattgggggagaagtttatagctgctgacaaaattttccatacacttcaatcagaaagaaacaaatgagctgtgtctatgtgtatggtgtgtatgtatgcatgcatgcacatattttgtgtgtctgtgtacctgagtgtaggtgaacatggaccttttttttacatgaatgggtcccctagcgaaggaggcaagacctttaaattttatcttttgaagttatgtaaatttttataacaaataaataatatatatccatgggccaaacaaaaactaaagtaatcacaaattatgagtttcaaaatcaaagcacaattgtatatacaaaacaaaatccaaaattaataagaatattctaaaatattttcatagttaagcaaaatgttattggttcatgttgagaaataaatgttggcttctagagtccaggaggctttctaaagttagaaatctttctttctaacgctacactttaacatatctagggatacttcatgagaaatctaatattcatacttaatttttctattaatattataattaatgtttgataatggtaactccaatatactgcaataactttagatattagaacaattcttatcacaaacatatttttataacagggttttcaatcaagggtcaaagaatcacaattcaaatagaaataatttaatgagcacattttatattttacatactttatttacatgaattaaacatgcaaagtgtcttagtttatttaggctgctataatgaaattgatggaatggcttataaacaacaattgatggaatggcttataaacacttgtcacagctctggaggctaggaagtctaagatcaaggcttccagcaggttcaatatccggtgaagtcccacttcctagttcatagaccagagattttctgattgtattttcacatgttggaaagggcctcttttataagggtattaatcttgttcacaagaactccaccctcatggtcaaaccacttctcaaaatcttcatccccaaatattataacattgagggttacgtttcaacataagaattttgagggaacataaacattcagtttaaagtacaaaagtaaccgtattcaatagtataaaggaaacctaaataatgattcttgtcaaactcatattgtccaactactgaacttcgaaacaaatgagaagtcgtgccttttcattaatgatcaagagaaagttgttagttctgtttcttgatccaaacttttgataacggagaatggattattacaacttaaagttgaagagtatatgtaacaaactttgactgtctcaatgtggcattcaaataggaaccaagagacagccaaaccttagtattcagcttttctccttatgggtccagagcattagaactaaatgcatggagacacacccaaatggaagacagaatctcactttattatttgctgaatgaggggcttataacttattgtatggggctctctggcaaaataaaaagaaaacaaataaaccaataagtagagaaaatttcccctgctttccttcttcttattctgagatggccagttctcagagcagcctcctttcgctttcagatgtaggcagaaagtaaaccacaaggaaagaatcaggctattttaaggtagagtgggcatttggttgtattaaaattgtgtaatattctggaactaaaaactctcctaatgcttcactgctgcacatccctctttccaacaattttcttgaagtaaatggagctcttttctaaaaaaataggaaattttggaaagtacaatttcactgttgttgttacacatttgaaaaatcccacaatagggctctttggtaaaaattagattggagagtgtggtctgtgcctagaaatcaaattgagacttccattttttttcccacccttttcccaaatccaaggtgggtagaagtccagagcaaatccaaagtccgtttagtcaaccagacattgcaaatgggaaaacctgctaggctttaagctgagctctgcctaagcaggtcctctgggctggagtggatttgagagccccatctgacacatgacaaagtaataacacttactgatagaatgtagctttgacaacttctgagttaacgtgggccagttatcagggtacttcttagccagattggtctatagttttagatttcacagaagggatctaaaattgaattctagcccactcagggtttattaagcttgggggaaaatggacagaatgtaattgagttcatcaatgatagtatgaaaaaagttgtcagtttatgatgatgaaatatatagcagcaaagcaattcaatactttgtctactgataaaagcatttgttccctaaaagagtatttgggaaaccaaatattccaaaatagtagaaaaattgctgagtgaagatacctataaacaaaatgtgtttttaaaaatctgctattaagaataacagattgacttaaaattctgacacttaacgaaaaaaatgctgccatttagccattttatcacataatatttatcgcttatgttgtttacatacttgaacttatattttctgcataacattgaagtatgcattttatcattcaacattgtgccaaaagcataattttcttttcaggggaagccttgaggatattatgtaaatagttgtgtagcattctttcgtatatacaagtaccataattgattaaaatatttactttgttgaccatttaagctgttaacattcttttttgctgctacaaacaactctctcctgagaatatttctatttatattttttcaatttcagatcatttcttagagtacatacgatgaataaaattatttggatcagagtctatgaacatttttaggactcaatatacagaatacacaatgttttaaagtttgtatcaatatttatttccttcagtctcttgtgaaactgctaaaattaagtattatcaggtttttaaacctaggctaattcatcaagcaaagaaaaagattgtagaagtatttttaataatatagttatttaattataaataaaataagcattttgacatatttgtttgtcatttgtggtttatctttagtgaactgcttattgtggtactttatctggtttatagaagtatcttttcatttcatcagtatgcaaaaaaattatagactatgtgtatcaatttttgccttattgtgaatatcctcctagttgatagcattatattgtatgatagttttattttaaaaacattacaaatattttaaattatggttttaaaattaaaatattttaatgttacaatatttttaatgaagtagtttaatgaagtaaaattttttcttctttgtagtgttggtttgaactgttacttcaatctttaaaagaatttattttgcaagaacgcataaacttttgcctaatgtatgttacttattaactttaaacattaattgtttttggctgggcatggtggcttacacctgtaattctagcactttggaaggttgaggctgacacatatcttgagcccagcagttcgagatcaacctgagcaacatggcgaaaccctgtatctacccaaaaaagtaccaaaaaaattagccagttgtagtggtgcatgcatatactcccagctactcgagaggctgaggtggaaggatcacttgagcccaggagagagaggttgcagaatatttagaaggcgagactagaaaaagtagcttttaaaaaaaagtgtaggccaagcattgtggtctcatgcctgtggtcccaactactcaggaggccaaagcgggaggatcatttgagcccaggaattcaaaatcagcccgggcaacatagtgagagcttgtctctacaaaaagtaaaaaaataaaaataaaaaataaaaaaaactgggtgtggtggtatactcctgtagtcccagctactccagaggttgaggcgggaagatcgcttgagcatgggaggttaaggatgcagtgaggagagactgcccactgaactccagcctgggtgacacagaccctgtctcaaaaaaaaaaaaaaaaaaaaaaaaaaatatatatatatatatatatatatatatataaatcaagtttttattcatcttgtattcatctgaaattagatgctatgggcatgtgaattgttctctttgtgtgataaactttccattgattaatgtggtgtttttaacacgatttattatgtggatacacacttatgaacatagctctttcctgagataaagaatcttttccatttttccgcacatgtttttattttagcattagtaccaaactgacttcatttgtgtgcttgtactccatgttatactccatggctatataaatcagcaactacacattttggagttttttgtttgttttttgtttttgagacagggcctcactctgtacaatctgtcacccaggctgaagtggttgttttgttttgttttgttttgttttgttttgttttgttgtacagaccagtgcccaagctggtctcaaactcctgggctcaagtgatcttcctgtctccaccccaagtagctgggacaacactgtgagccaccatgcctaccctacacttctttttaaaagtattttttctagtctcaccttctaaatattctaaaagtattaaagataattttgataaattgagaccgaattaaatacatatataaatttcgagaaaaataagatctcgaaaaatacgaactttgccttccagacacagaatacttgtcttctttgattcaattttgtttccattcatttcaacaaagttttgcagttaccttggttgtattttattttcaccttgattttttttcttacacttaggagttgttttgtgtctgtgtgtgtgtgcatgtacacttgcatgtgtgcacacctgcatgttgttcttaccttttttattctagctttttctattctcctgacttactttacataatcgccaaataatatctatacttcttttcatatagtttgccactgtctattgccattctgtttatttaaagtcattcatttttcctctaatcaagtagttgcttttttatagtataatgatcaaatggcaatcttacttccctctttcttctcagatttccagaacctactttacttttctgcatgctttaactatatcttataagtcttcaaaagggaacatttagaagacggtgacttgagcatttgtttctgatcatttctctcttccaatttactatttttacatcccagccactaaaataattaaaattttctattgagatgtgtacagacatcctattccatctgaatctttggagagaaagtgtaggtatcagggcatcttttgttgcaattgagagacaatcaataaactaaagtcttgaaaagaagtgtgtctatctaccaggcttgtgcaagtaagcagatttctgagttgcctagaggagagatcatctccttggagaaggaatcttttggaaaaaggaagggggtttgcttctgctcgtttactatgtgttctctatgagaaggaagctgtttattctgattcagacagaataagaggaagcagttgtattagttgaagcccacctctcctggcttgcttctgggagcagagacacctcctggggtgaggtcccagattttcaattccattgtcaatgggtgactaaagaagacatcatatttctatctgccgagggctatgtgctcatactcgacattacaatataattcaaatggtcgatggaatctcaaaatgacacagagaaataaaactaattgtcaatttggaagaatcctgtgacttgaaagggaagaaagagtttaataacttgaaccgttgtctaatataaatatatgaatgagggcaagaatgtaagaaaatgtaaataggaaatacaagtaaggagttttaaagagatttaacacaacaaaaaagattttggagctgaaaaaaagtcatgattctcagattttaaaaatatttaaatgtgaattggttaaaaatgtcaggagtcaggttatacttagattgcaatataaagtgtgatttttactcatgctatgtttatttgaagttttagtcaaaagtcaaaccactagtaagtggtagaagtgaataaaaaacacatctgtcattgtcataagtccattttcttctcaattatattatctctccgaggtttaaaatcaaagtgagagccagttgccagttttaaggtgagagggaagggaaatatgaagggcacagggctcccaggaagcccagaaggagaggcctcaaaagaagactgtagggaatttgaatccagcttcacttaactaaaatttggctcaggtaggaataagttacttttcctaaaatgagaaagctcagtcacaaataaaatgttctttttctttttttcttctaaggatatctaagtaattcaccaggagagaaaaaatgtgttactttttgccaaattaataccatcttaacctgaattaccaaaacatggaaaagcctcagagaaagaggacatagttaaaaattgaagacaaaagcaattctataagggcaaaatacaatcaaatatttctgtatgtacatacatatatacatgtttacacatacatatacatatctgcatatatatgcacacaaatatatatacatatgcacatacatacatgtatatgtgtattcatttattgataatgcatacgcatgaatgaaatgttagaaataattgtatactttaattgctctactctcctgtttctctatttttacatataaccaaaaaaattttaacatgttcagttgatgatttatcgtagtcaatgatcccctttatgatctgaatctgcatgaaaaataaaacattttatttctctaggaaggcaaaatattttgaaaaaaaaacaaaagttacatattttggtatcagaaaacatcttattgtcttttaaagaaagacacatagaacaatttaattatagagttgaggtagttttctatgtatatcaggccctccaaacacacccactaccatttcaggctggcattcaaaacatcacttagtcactacccagcattccattttgtttgactacatagaaataacatttttctgcgtggatgaatggctaatacgtacaatggaactgacttattttgcaaagcatttcaaggtcttccagttaatttgacacaaacttattccattatgtaaataaaaattacaccatattacatgggctctaaggaaaatgacaaatgcagattgctatgcatagatacatagagccatcattaggaatatgtttggtactaatgtgggaaaaaaacaacaatctttctaattagccatgaagaaaatacacatacatattaataactggtaacagtgattacctgaaaccaagaaatcagttattgtacaaattcatacaactagaaaaaaatacttatttttcttctttaaaagactatttgtaatactaatagaacttttcaggtctttttttctctctctgtattctctctctctctctcccttcatccttttcacctcctttcaatctgactagataatattttaaaaatacatttgtttaaaaaaattcacccagtctccttctctggcaagggagaaggttgtttaatgagaagaacagatgcttcactgtctagtcctccagtagttcatgttgtattgagctcagcagccctagtcatatattgcactttcgttctgtcattcaaatgttgcaaaatcccctcaagctcctttatttgtctagtgaaagaaaagaactgttttggtcatatcatttcaaaatgtcttgttgtcacaagacaacaatcttgataatcttgaaaatcttgataaaagacttttgaaatgtcccagaaaggccaaatatgtgcttgtattatttatttcattttttattatgctagaatttaatttttctcttaattaacctttgggcttttttttctgttacctacccattgtatactaacttaatttttgtaataaataagctccatgattttaagttctattgctttaggagatgtcttgatttattttagaccactaaacacctgaatttacaaacttgctgcttccaaatgcatccaccctgaacgttctcaaaactcaccatctcttaaggacttagcatacgccaacattgcactgtaaatgctttggaatctgttatttaccacccattccctgcttttgagcttggtatttttatccacttttttttttttttttttttgagacagagtcttgctcttgctgtgtaggctggagtgcaatggcacgatcttggctcactgcaacttctgcccccccaggttcaaacgattctcctgccgcagcctcctgagtagctgggactacaggtgcacaccaccatgcccagctaatttttgtatttttttttttagtagagacagggttttgctatgttggccaggcttgtcttgaattcctgacctcatgatccgcccgccttggcctcccaaagtgctgggattacaggcataagccactactcctggcctccacattttgtaagtaagaatactgagagagaaatttaataatgtgtttaatgtcacacggcctagaagtagaccaaatacgaatcaaatgtctatctgtccagtaaatcattacaaaataccaactcaccaattttattgctatgaaataagctcaactgtgctaatatttatatttttataagactgctgtttcttactgccttacctttccccaacctcatgtccccaaaacacacacatgtattttctcccttcgtagaaagtcatatctcttaaaagtaaggaaatataatgaaagaaggttggtcgtgaattaaaggctatcgataaattttcaaagcaataaataactattgtggctacatccaaaatcagcattccaaaacacatttcaacaaagcatgtcacattttaaaaaatgcaattctaagatacaaccacatttttcatatgactggaatcacttggccttttgccctgtgctccatgaaatcagtgatgttgtacagagaggggaaaaatagatggctgttctagacctctgaatctcctgccaagtccccctatcagagagactatgagtaacccttccctgcctggcatcataattcatcactctacctcctttctgcttcctttgctacctgggagaaaagcaatgtaaaatttaataagttgaataaaagttatttttcccaccatctgtatggattctggaagcgtgccttgcaaagtacttttcattactaggagctatgtaataccaaaatcctgcctaccagctgttggcaccagagtaagtctaagaagttcttgagcggccaaaatttcatctcatttccctctgctgtgaagtccttttatgcatcttagtgccttccacccttggaaagctctgcaggggaaggacaacgtagctgaatatctgtgaaggctagggtaaacacaagcactttgcttcactttcttcaattagcttgcccaaattcagaaggaaagagtagtttctcaatataatctttcacattcatgtttcaatatagtaagtctcatcagcctcataaaattaaaggctaccataattagccaaagcatggctgatttatgttttttctcatttaaagatgtttatattttaaatgtctatagaatattacagatttttccctaaaactcagttatttctagttttttctataactactttttttaaagaacttttttttggcttttattttttggttttgttttctaaatgtatatgactctaaacaaagtgttttgcaaaaccctcttttgcaatgaaagaaaacactctttctgcttttttattaaagacaattgtttattaacccaaaatgactacttaaagcaggtcccatctcctcaaattagtctgttcttttgagtgctacagacaatccataaagccctttagtgtctctcctgggtggtaaaaatgcagttgtgttacctgtacttatacgttgggctttctaaactttatatcatttttattgttcttatttggactctccccaatttaacaagacatttttttaaatgtgtgcttgaaaaatgcacacgataatgttcttctgaaaaaaataaactcccttatcctttatgtaatacctctgctatacattcacatatgagccgcaatttgccttgtgcctgaagcattacattgcaaatttatgttaaatgagtggcccactatccaaatccttctcctgcaggattatttcattttcttcattgactagtttatataatggttctgtctctccaaataaagttactcctttttgaaacacatattcctgatccaagcctatcccaggatctttggtgatatcacctgctaaatataaacccttgattcaaatattggccatattaaattttgtagacattgtagtcagatcatccaagaacatctatgctaattgcattgccctcaattgattttattttttgtttttctgtttgtttttctccctcatttgtttaaagacagtgacaatcaagtcagcattatgattatttggcctttggtgcccatactgctgcatcaattttgcaatgaaccattaaagttaatgtctgaatagtgtacgcttgaagtcagactcttcagaactttgagacaaattagttttcaaaagtgtattctaggtcatagacaattttgattgtacacaaacctttcttgtgtcacacttctgagacgtgggaggcaggaggaggttagtggagctttgaatatatatttaaattccaagagcagtgttctgacctagaatgggtacaatgttcaaaaatcattaagataggatttttgaaggcctaaactcaaatgggaaattgtggcaggtggatatgggattgccccctccttgtcattcagtttgggcacagttgatatcacctctttccaactttgggatctggttagaaatcagatgggtttattctccctccttgccacagtaatcaatttagcaatcctggacaaaataacaaaagtttgtgccttttcttcacctccaggtggtcccatcagcatctatatttggtctactgattgtggccatgtgaaaaaaacaataatcactatttttcaatataaatatctcatatgaaaataacatgaaaaatattttagtaagttttacaaatttttttctagcaaatcttcatgctgttatgttaaaagtagtcatgagcattcctagttcatcaaaaaacatcatttgagttttattagtcagcaggtttgaccattaaatgtaatttaaaatatcttagagttggtgttatttttagtcccactatatcagcagtccccaacctttttggcacaagggactggtttctaggaagataattttgatagggttgggggttaggggggatagtttcaagataaaactgcttcacctcagattattaggcattagattctcataaggagcatgcaacctagatccctcacatgcgcagttcacaatagggtttgtgctcctatgagactctaatgccaccactgatctgaaaggaggcggagctcaggccataatgctctcttgcccactactcaccttctactgtgctgcgcatttcctaacaggccacaggctgatacaggtcctcagcccaggggttggggacccctgcactgtattactccaacctgaaaaatatttgaaattcccaattcaaatgtaacatcataggtaggaaatatattttggttgtagtctttgtaacctttgacctccgatactgaactttgaaaaaaaaagactaattttttttttagagtagttttaggttcacagcaaaattaagaggagggtacagagatttcccacatgcccttctttctccacataatacctaactgtgttagtccattctcacgctgctatgaagaaataccagacattggctaatttataaagaaaaacggtttaattgattcacggttccgcaaggctggggaggtttcaggaaacttacaatcacggcagaaggcacctttcacaggggcgcagaagagaggattagtgtccagtgaagggagaagccccttatacaagcatcagatctggtgagaactcactcactatcgtgagaacagcatgggggaacctcccccataattcaaattatctccacctggtcccacccttgacatgtgaggattatcacaattcaaggtgagatttgggtggggacacagagccaaacaacaccaataacctccctcattaccaacatcccccacaagatacatttgttacagttgatgagcacacattgacacatcattatcacccaaagtccattgtttacatcagggttcactcttgatgttgtgcattctatgggtttggataaataaaaactgacatatatccactattatagtatcatacagagtagtttcactgctctgaaaatcttcagtggtgtgcctattcatatcgctccctactcccaactcctggaagccactgatctctttactatctccatagttttgctttttccagaatgtcatattttccaaatcacatagtatgtaactttttcagattgccttctttctcttagcaatatgcatttatatttccgccatgtcttttcatgactttctttgctttagtaagataaatctcaaagcagctaagtttctatttctttgcttgtgaggctatagtgtagcttatatctttactgaatcttgtaattatgtctgacctggactttttttttttttttaatttcctgttatggagtggaagacctgctgcttggcctcaggattagtgaagagctaatctgagttttagtgatacatgaactcatctcaagatttccctgtagaatggcagagcctgagtcctctggaatcatctacagatagtgtcaccctattgcatctgaacactacacttatcattttaacagaacatgacatttgggcctctatcattgcctaatgaccctactaaaccttgctagtttgttttttccaaaatgtttttgctctcttctaatccacttgcatgctcttatgtgaaccacttctttctccctaacctttacctgtattttcaacttataacctgactcatgcttcacagagaaaagacaagcaattgaatgaaaactttttggacttctccctgggctatccatgaacgtgtggatacacctatctgcctgccttccttcttaccataaaggatgatgtgtcttagattttaacagtggttaatccctccactttcaccatggttcttattccaccttttctgcttgaggattttgctgttataattagtctcttcctctcccacttgatcaactagatcatacattctagatcttttcatctctaatatttcctactttaaaaggcacaataaaacaagaaatcaattttttgctagtatacacaattacagggctccagtcttgtttactggtccatctttctctgtcagtcttctaaatattgaggtgacccaaaactttattctcagcatctcccctctactcgcctctttccttcactttacttctttctgtttctttcctatctctgtacgctctacctcagtgattttctctttcagagagtcattgcaaacgactctcgaatttgcaattataactcagatttcccagcagaccaccagatgtgtatatagccatctacttggcctctgcacttggacatctaattgggaattcaaacttagtgtggtcaaagcagatgtcttgatgtccaccccatccctctcttatccttagcaaagttgttcaggacaaaaatataggaatcattttaatttccatgtttcatatatctattacctaaatatccaactttaactttcactgttacccacacaatgggtgggttctatcctttggtgagtgacagtccaatgatcattaccaaggaaaatttaacaaggagattttattacctgcaagtaaggagggcacccaggttagctgctaaagcagtgccttcctgaccaaaggtgaaaacagagctttcattgggctgattagttgagccattgcatgtagaagtggagtaaaggcagcagaggctcagtcaccagtcatgcttgttcatgctttgcatgtattgaaaatggtgaatcagttcctcttggggtgggggtgttagtatggtaatgctgagttcaccaaagtttatctccaactctgacatctctggatccaacaggtttttgttgttgttgttgtttttcctggactgtgcttcttcctggaacttttgaaactacaaaatctcagggtgaaacaattaccagtgggtagatttatacagtgtgtacctgaaaacccagggaccctgggttacctcgccaacaccacctctgaaacatgttctgaaagtgtctacttttttccctcctcactatccgcaccctagctcaagctacctctactacttcgtcttctctaatagcttcttaatatactatagtagcttccctgctttatgtgttccaaacatactctatcagtctcagaatgaaatctaggcaccatgcttgctgcatgatctgctttctggcttctgcctgatgttatcgcatgttctctttcttaagttctatgttctaatctccaatttatagaacatgctgatctgtttcttgcattcaggcctctgcattcactgtttcctctctctaaattagaatgttcttttgtgccctacgagtcctgtgaatgtttatctcctcctatgaaaggactttcccccactttaattctcagtacttcacttcctccagtcgctctttattccatcactctagtttgttcttttttacacattaatagacacaatgtgaatctgcttactaatctgcccagccctctcctttatattgtaaattccatttcagcaatggctttgttagtcttcctcactcttgtatgcacagcagttagtaaagatacttttgtgaaagaataaatgaaattcctttacccttgaacgtgtagagctcattgaagtcttctaactttattccctaacatggatattttacaaggagcatcttttagcaggctttgtaagcagtttggtgcctgcattcttgttctgactttgttcatccatctctcttggcagcacaaatcagggacaaggaatccctcgtctcctcctgcagaaatgtcaggtttggtttggttgtcatccacagatttttatttattccagcacacactgatgggctaatgggcctcctaaagagactcagcagaaattctcccttccagctggagactgaagaactctggcttaaatgaggagaaatccttgacaatgttattgctagataaacttttatcctgaatatgcaattttttcctatgtattgataacctaggtcattaaagatgattaatgtctgccatattccaccagcatttagaacaattcttaaaaccagttatagtggcactaaaattcattcatccagcattcagcataaaagagattctttaaaattaacaaatcaattataaatatatgtagtgtgtatatatatgtgtgtgtacatatgtgttatatataacacatatatgttatatataacacacatataacatatatatgtaatatataacacacatataacatatatgttatatataacacatatgttatatgtataacacatatatgttatatgtataacacatatattatatataacacatatatgttatatataacacatatatgttatatattatatatataacacatatatgttatatatatataacatatatatatatcctaaatttcctcatacatagtatctgacaacatatgtgtaatttctgcaggaacaagtaagccataaatggtgctagacacctcatccacaaaattccacttagaagatttgatatttgccttgagttatttaatcattccataatagttgaaaatgtactctatggcaggcacagttctgggtgccagaatctgatatggacagacaagaaaacacacctgctttcctagttgttcggggaaaagtataatagggaaataaaccagtacatttatattcattatgtgatgctaagccttatgaagaaaatcagctgggtaagaaggtaatagaaaaagggtgaacagagcattgtattctcaatgggttgcctctctggcctcttcgataaggtagtataggaaaatgtgagctatggagtcatcttgtggagaacattcccagcaggagaaatagtaatgtcgctgttttgctattctagaagtggtgtgttctgaaaacggaaaggatgcattctggctggaacaaaaagatgagataacaattttgttttcaaatcatactattgttcatagctgcttattggcatttcagatttgggaatttgtgggttacttgattagaaagacatgggaaatcaaggacaaggttaaacaacaagagaaagaaattagagttcaataaagcaaaaacagaacagtggaagatgatttaatagtgttatgatttgaatatgtcccccaaaagttaaggtgttggcaacttcatccctctgctcttatgaatggattaatgtcagttttatccttatgaatggattaatgtcagctctaccttcaagaatgaattaatggattaatgtcactgtcacaggagtgagtttgttatataagccagctctgtctggctctctttctcttgcctatttgccacatgatcccccacaccacgttatgacacagcacaaaggccttcaccagatgccaacaccatggacttggacttcccagttcccagaactatgagctaaatacacttttgaaaaaaataaattacccagtctgtgatagtctgttatagcaacagaaaacaaagtaagacagatagtaaaaaagatctctgttaattcatgttctagaaaggataaaatatacttctaaaagtatattactgaaagcactgtttctgtgatgacgccttcaaaaaatcattgactggaaaacaagtttgatatatgctttgctatggtgactatagaataatattattttatactatatccagacatatgagaggtataaaaataaatactaatataaaaaatactaagttagttgtgttgatcccagaatcacagaaacttatttaatcacagaaggttttacacatgtaatacattttgaaaacaattgcctcagaagtaagagtcagatctgatgtagcgaggtgaagactgactaatgaaggtgaaaattgtactatagtaaaaaaaaagatccaaatgcaatggcttaaatataatgagacatagttagactcaatgacatgaagttatccaggtaccaaggctagcatggatgaagtggatggttgagggtggaggatggtcagctctctcatcaacgtgtggttttcaaggattgtgctattactcattacctctcagctgagcctcatcaacattggataccagcatttttctttgctgtgtcctgaaagaagagtttaattattgttcatttctacactgatgataaatgtgtgccatcgttattaaaacattatcctgtcagaacccctgtgtcttacgttagcttgtctcatgttccttgtaccctacaatgtcacaaaaaacaaagctcaagatcaagtatggcaaattcccttcagttgtaaaacccttttggtgttctgcttttctcattgggttccacatttagtgtgttttgtttgtttgtttatttgttttttccttatttctggtcagcccatcaatgcatttaaggtagtgtttgttgtatataaataaattcaattaggaaaaaggaaaagctatttattcagagcttgctagtgcaagggagtcagcaatagtatcttgcattttggcagagactcaaatgcaggcggaagagtgggaaagctttattatggaaaaaagaaagacttcaggaatgctctgattgaggactattggcataagaaaactaaaggcaggctaactagaagtagggtatgctatgtgactggataggaatgcatatttgggctttctttgcttgggcttaggaaagttatctgttcataagtcctcttatttgggatcaattgttacagaagtttgtgcttggcttccaagatggttactagagatagcactctgacttctacaagtctgttttataactggctggctcccgggctctttattgtagataaggggtttcctgggcaggttgctgcagattgtgggtcagatccacatattatacttcccctactccccacttcacatggtaaattataatccttcataaggcctgagaagcccgatgtgatcttatttctgcctagctgtttgtatattgtttctcactagtttattgattttttttttcttttaaccaatatgtttgactcttcacagtagatggtttgctcagggaatctatatcaaatttttagtgactaaggtttggtccttagggtttttttctacttatctttttaatactcctttctttaaattttctcccaagtgatttcatgcagtttcatatcttcatatgcattctttatgctgatgactcaaaattacagcttcaaataacgcctcaccttgaactacacacgtaaaagataacacattacttgacatctttacttgaatatctagaaggcatctcaaacttctaggatttcacagaactattcagatctacctcacaacgtactgtactgtccactcccaaaccatatacttcccagtaaatgacacttctgttgactttgttgttcaggctaaaacttagggtccttgattcttcttgcctatatccagtaactcctatcagatttgtctccaaaatatatttcatactttagcaaatctccacatttctgtcactaacatcttagcccaagcctgcataatttcctgactaccaatagccttctaaaagacctgcctttctttgttctttttcctatgcagtctatcttttatacagcatagaagatttcattttcttcctcaaactataaaatatcaactttctgaattcccatttcacatgataaatcatgatccttcatatgtggcctacaagacccaacgtgatcttatacctgcctaattctcacttatcgattctcctctctccgttttgcttttcacgaaatacaattcttaacattagactaatgatttctgcctcagtaacatggaacctgctgtttcttttgcttgaagtcatctttttccagattttcacaaagctactaacttttcttctttaggtttatacttaaatatcatcttttcatagagaactttcccagctctgagactcacagacattctctaccacattcctatattaaatattaataataaaagctcgtgcaagcccttgaaacgatgtctcccctatgtataagctccttgaagccattaaaccatttttctgattcactgacataggtatagttctaagaacagtaccaggcatatggcagatactgaataaatgtttgctgattgattaaaagaaactatggctggagttgtgctataaaaatcaaatggtgaaagagaagcagtattcaggttttttggaatatggaagagtagggtgccttctggagataacagctggctgctatgattttgattgcccataaaacattcatgggtcaacagggaaaaagagattactataaacacctccttccctctagaattttacctggggaaataaacaaaggtcaaggaatttttattgattctcccattgactagatgttctgaagcagtggtaattaattaaggaactaaaacttaagtacaggataatccattgcctgaagctagagacagcagcagggctggagattgctgaaaagcactacagttctcaactacaaagtgtgtgtaaagagtactgcaatttggctgagggctaagctctttgaggggacaataactactggggacagggagggactctgtaagtcaaagcaattgactgcaaaatcaagccttatgttaaggaggcagctttgatgtaattgtgagagcactgatcttgacatccagagatcagattcagtctcaagttactacttcttcagtaagttagatccttaacttccccttatctctactccctcacctgtagaactagcagagtaacaactgtttcatagtttattgtgactaatctcaataacgtggaagtaagaaccacagaacaattatacaaattttaggaataagccctaaatacttttatattcctccttcagataagacatttgttgacaactaattgtagattacattgacatgaagaaaaatttagcttccttaacaatgttcattgttaatcctatattctccatcccaccttatcatttaaaaatcaggtatcattgagtattgcaatcaaaaatgtaaaacctgcttcaaaaggtgattccattatcttgtaaatgcataaaaccttgtggggagaaggaattaatgaagcaaaacaaacaaaaaaacaagacatttgggttatttgaagcagttcagtgacatctcgtgtcacaatgccaagagtgcggttctatcatccacaattgccatccacaattgcctttgtctgtgggaacttctttaaactgtgctcagtcatatgcatgctttacaaacttttttttttaacattggttacagatggtcatatagcatatgacaaaatataggctcagaaaaatcaaataatggatccaggcactgtgcaatcatctgggggtagtgtcctgagaaaaacaggcactgtccctacccttcttataaaagtgcacaacacaatatggaaaacagggctttaattaagcaaacaacattgtcaaattgcaaaaacgagaatatcacttggggcaaatgcaccaaacgagaagctatttcttaaaatcaggtgtactaaggagatgttttcttgattgggaagatttgggaggagttttaccttgcatgctaacttttaaaatatgctaaagattctaacttttaacctgtgtaatggtacttttggaaaacttgcttttccatttttagtatgtttgaaacattttgtttataacaataatgttcatattatagacaatcctgcatgttttctatcttctctttcactatcaattattacaagaatttcaattagctttggcattttaggaatattatgtattgttattttctaatcgccatgttataattctataatgtttatgtttagaaaatcttgtatttattgtttcatttattttttctatgacttatgggcaaaatttcaaataatgtatgagctacctatccatctaaattctaattttcctttttaaatattataggattttttttctggattgaagttcttgctttcttttttcttacaaacacattttcaagcccaacaggtatctttttgtttgtttgtttgtttgttttgagacggagtcttgctctgtcgcccaggctggagtgcagtggcgcgatctcggctcactgcaagctctgcctcctgggtttacgccattttcctgcctcagcctcccgagtagctgggactacaggcgcctgccaccaggccaggctaattttttggtatttttagtagagacggggttccaccgtcttagccaggatggtctcgatctcctgacctcgcgatctgcccgcctcggcctcccaaagtgctgggattacaggcttgagccaccgcgcccggcccccaacaggtatcttaaaaaagaaaaatattctggtaaagtttgccgatagtttctaaaacagtcaaaatagtcatggcatctcccttctgctctaataccctgccagaaatgagaaagagagagagggacaaagacagagagagagagagagagcgatcactgtgttagaaaagtgggcaatcatatagaacaatacagaagtcaccagactgagcaagttaattatccctaaaatatttttatcctagtgagtgatgaatcctttaaatatgtgtccttaaatttgtgagatagtttacattgtagtgtattgcatacagctctttaatgtattcacacagatcatttagtttggcttaattaattgtttggtctcttttgcagagaggcatgtttggtagagggaaaaattcctttggataaaaatgcacctttgtaaatgacatgcaccaggttgtgtgtttttcctctaatagcaccaccattttgggaattgacctagatgcccaagaaagtcctcattattgagaatttatgtttctctggtggctttcatttgctaaattagtctctgctgcatattaaacatagatagctaatgccactttattgctgctggtcctattcagcatctcttttcacagaatgcaatctacataattagaaaatagcatgacttctgaatctggcacatcaggagggtaaagatgtcgtactcttgctttcatttcatatgccaacctttgtaacactgatgggataataacattctttcaattttataatggtaataggtgtactgaattgtgttgctggaagtacgaatgaaacaaagggaagatatgaatttattaatacaagaaaacataagattcaagttagttatcaaataaaattaaaaaaacattttgtattgcagaaaatcgccacatctgtactgtcactaaaaataattgcaagacatgtgagacaaatagcatgctttttataaaccagtctacaaactactcaaattcttgctatgtatttcatattcatatattttcccattattcatttgtgtcccatttaagtaaagctcataaagatattataaggtatattcctaaaatctctacataatatctctgttatttgagaaaatatcaaattttacttatgatatttttgagggattacaacataaggccaattatatggtttggatttgtgtccccaccaaaatctcatgtggaattggaggagagacctggtgggaggtgatttgattatgagggcaaattgctattctcatgatagtgactgagttctcacaagatggtttaaaagtgtatggcacttccctttgctttctctcttctgccaccatgtgaagaaggtgcctacttcccctttgccttctgccatgattgtaagtttcctgaggcttctcagtcatgcttcctgttaaacctatggaactgtgagtcaattaaacctcttttcttcataaattaccagtctctggtagttctttatagagtgtgaaaatggacaaatacagaaaattggtactaggaaagtggggtgtttctataaagatacctgaaaatgtggaagtggctttggaactggttaacaggcagagtttgaaacagtttggaggcctcagaagaagacaggaagatgtagaaaagccgggcactttctagaaaattgttgtatgattttgaccaaaatgctgctagtgatatggacagtgaagtacaggctgaggtgatctcggatggaaatgaggaacttactgggaacaggagtaaaggtcactcttcctatgctagcaaagagcctggcagcttttgccccttccctagagatctttggaaatttgaacttgagagagatgatttagggtatttaacagaagaaatttctaagcagcaaagcattcaagaggtgacccagctgtttctaaaagagtatatttgtatgtgtgaacaaagagattatttgaaactggaacttatatttaaaagggaaacagcataaaagtttggaaaaattgaacctagccatatggtagaaaagaaaaacctattttctagggagaaattcaagtctgctgtagaaatttgcataagtaaagaggagtcaaatgttaatagccaagagaaaggggaaaatctctctagggcatttcagagacctttatggcagcccctcccatcacaggcctggagacctaggaggaaaaaaatggtgttatgggccaggcccagggctcaggggctctgtgcaacctcagaacagggcgccctgcatctcagttgctttagctcccatgactaaaagggaccaaggtacagcttgggccatggcttcagagagtgcaagccccaagccttggtggcttccatgtggtgttgggtctgtgggtgcacaaaaggccagagttgaggtttgagaacctccacctagatttcagaggatgtaaggaaatgcctggatgtccaggcagtagtctgcttcaagagtggagccctcatggagaacctctactagggcagtgcagaggggaaatgtggaagtgattggaacatgggggcagatttccaccttgctattctcgtgatagtgagttcttatgatatgtgatggcttaaaagtgtacggcacatccccctttgctcactctctctcctgtcaccatgtgtggaaggtgcttgcttctccttccccttctgctatgattgtaagtttcgtgaggcctccctgtcatgctgttaagcctgtggaactgtgagtcaattaaaccttttttcataaattacacagtctcaggtactatttaacagcagtgtgaaaatggactaatacagctagaattttatttattgatatgtatgttggtagctagtaaactaaattcaaccagccattattaggtatgaatgatatacatggatatatcttagatactgaaagggaagttaaaattaagaggctgcttcaagttgattagagtaaacttgaaaagcctgatatgtagaactagtattttaatatggcgctgtcttggaatagtaaactaatatagtcaatgttgattcatggtcactttcttgtctttgagggaaaagggtgtattcgtatcttttttatagggaactgaaataaacatttccaattttgagtgcattttagattgaatctttagaatgttttgatatagaaatctaaattttaaaaaactttataaaacaaatgaggttttatttaatcacacatttattgaaaagatgccttcctcaaattcatttatcataataaggcatacatgatcatattactgtttcaacagtattattgctggttttgagagttctcatctgcaaatgtatgtttatgcacacatgtatgcatgcaaatatatagccatacatactcaaatatgtatctatatttatgtttttatccatatcaaagtccatatctatatcactaactatatcaccatctatgtctgattatatacctatcgaaaataagattctgctggtagtaaagtttatcctcacttttttcactgaacaatatgtcataggttttttttgtcattagatcagcaaaatgtatatgtatttgtgtgtaaaatatattatagataatgtagatttggataatcattttattagttttacagtatttcctggtgtggcatttcatacttatttaaccaagcctgtattattgattttgtaggttattttagatactttactattatatataatgcctttatgtatatctttgattaattgactattttcttagttctctttctgtaattttgatttattgataaatcataaatacttacatttaaaatggttccacatagtactcaattttatctccagaaatgctgtaccagtttacactcttaccacaattttgcgataaatattatcatgataactaaaattttgccactgtaataagttaaatcttggtagctctttattgttttcattttcctttgctcagtagtgcctcttttgatttgaataatggcttttctactcaagttcttctgtgtatttggaattgaattaaatgaatttcttatttttctactgaaataattactaattctcttaattgtgataacttttagtataagagatatttacctactgtctatcatgaacacaacacttttttttttacaaaattttgttctctttaactttttaaaaaaaatttgattgatactagttttcttatggaaacaatgtttatgtggttaaatctagcctttttccttcatgatttctaatcctagtgtcatacttagaaacatctttgctgtctaatatagattatagacttatattttatgtgtgatttttacatgttttaccataaaatatctatagcactttccttttaggcatgactttttccccaatagctcaccaacagtgctaacataatttctcaaattaagtttcccttccacagctttgaagtgccacatttacttatttacttatttatttcttatttaaaattttttcttagagacaagctctcgctttgttgctcttgcttgagtgtagtggcaagatcataactcactgcagttttaaactcctgggctcaagtaatcctcccacctcagcctcctgagtagttagaactacaggcacatggtaccacatttagctaatttttaaaatttttttgttgagacgaggtgtctgtatatttcccgggtccacaacaattctcccacctcatttcccaaagtgctgcaattacaggcataagccactgtgcctgacctgaaatgtcacatttttgattaccaggtttacatatatatgtatgtgttagcaggtacatgtatataaattatatgactattttagaaataattcccacaaataaagtgcaataaaatttataaatagacctatatatgtgtgtatacaaaatatttaaatattaatacacaattatatataaatatatgttgtatatcgtatatcaatgcataggtcatacagtttgggtctgattttgaattttctactgtgtttcactgatttattcagagtcattaatataagtcactctaaaagggcagtttttatagtgcatgaaatattccaataaaatatagtatataaattgtggtatataaatttatatttaattttttaaatttatattttatattgtagtatataaatttacatttcttgttgcacactcttcatctggcatcaatacttctacatgtcaatagcatacccagtgttgcctctcttaaacatttactgatgggatcactgctatgaaaccccttcatatggcagccattatttgtaatccatttctcataacctatttaaaacaatcacctggagtacattttgaatgtactatgtttaaataacatatagcacccaagtgcatgaatatatagaggcaacagttacttgagaaaaaatagatatatagacatcaaaggcaaaagctagaaccgagccctcaaaagggcatataatggagagtgaaccttaatgcttatcttcaatctgtattcatgagaaactgagaaacaggaagctgcatctggcatttgtttgtgctacttccaaaataactggaataagtgtgacattagtaaagaactacaaacctattaaggctgagtctgcaagttgacaacctgggtgggcatggtggctcacgcctagaatcccagcactttgggaggccaaggcaggcgaatcatgaggtcaagagatcgagatcatcctggccaacatggtgaaaccccgtctctactaaaaatacaaaaattagctgggcgtggtagcgcatgcctgtaatcccacctactcaggagactgaggcaggataatcacttgaacctgggaggcagaggttgcagtgagccgagattgcaccactgcactccagcctggtgacagagcaagactccgtttcaaaaataataacaaattttaaaaaaattgacaatctctgtgataaaggtgttgctaaaatgcttggagcaggaagtggaacacaagatgaatgtgggagaaggtagtgctgatgcatatacaacagccatactacaggaaccctggcaggagataatggtagcttagacgaggtggtggataatggagagaagtggagagagtcaaataatgttttcttttttctttatttatttattcctttttttttttttaaattgagacagagtctcgctctgtcactgaggctagagtgcaatggctcaatctctgctcactgcaatctctgcctcccaggctcaagctattctcccgcctcagcctcctgagtagctgggattacaggcacccatcaaattgccccgctaattttcgtatttttagtaaagatggggtttcaccatgctatccaggctggtttcaaattcctgacctcaaatgatccagctgcctcggcctcccaaagtactgagattacaggcactgcacctggccaagtcaagtaatattttctaagtagagccatcatgttcatgaaatattagctatggggaaggaatgaaaggaaagtaacttggagaaatttaaaaacaaaaataccaaattctgttgtacaaatgaataacagaagcctaggttttagggagggaaacaaatgtacttcaaaacagattgaatttgagatgcctttcagaaatccaaaagggaaaatcaagtaggcaattgaatcacagaggacatgattgggcacaaaatgaaatatgtgaggtggcaattgcacctgcagttatagatgagattaccaagggagagagcaaagggatagaaaaggggctaagatttgagcttaaataactgtataggggagaatgtacctgccaaggagaaagacaatgaacattgaaagtaaacgggagaagaaaagcaagaaagattgtggcagagaagacaatgaaaaaatggtataagaaccagggaccagttatcattctggaattttgataagatgttaaataggagaacacagaaaatattttactttaatggcggtcacatgagattttagcaagaatcacgtcagcagagtcgtgaagctcaatgaacctggactaggttgggttgaggatggaatgaaaaatgagaaaggagacatctatgagcattggtggtgctttaaaaagttttattggaagtggagggagaggggtttattttattggctgaattctttttgagacccttaatctcctcttcattgtttgtacttcttttttggtgttataagttaatgtttatcactaaaatatttcccaaaagcttgatccttctggaatcttcttcctctcagctcatagtagtttcattttcccaagtcctcaggacaaaaactttagtgttatctttaactcacctcttaatctcatgcttcacaacactttgtgagtaaatcctgttggttctgtcttaaaaatgttttcaaaataagttttttcatcacttccacagaaaactatcttgtctaagactttctcttgctttatctgaattgtaattgtaaaatctccctaagttgtatttctaatctgtctttgccccacttcaagacagttctcaagagactgatcctttttatacatattagatcctgtcatttccatgcacaaaacactccatttaaacatgagctagtgatatcctagctcacttaaatgctaaagtttttacaatgacatcctaggtcctcaaggattgctgatttagctcaagattaattgttctccttgctgttcctcaaacacaatatcatactcaagaatgttcttggcccagggcctttgcattaactgtattttctaccagaaatagaattcccttagatatttccgtagctcccacccttatctctttctgctcaaaggtcatcttatcagtgacaccttgttaaataatattactcaatatagcaaactttagtcccttctccccaacctcatgacattccttatcccttttctcctttttcatcctctatgccacatatcatgtaatgtattagagattttgtctattcgcttgtttttttacgtgtctctctccattacagcataagctacattagggcagaaattactgactaatcttataactgttctagttctaatgaccataacaatgcctcatgtactgtatgagttcatttgctatttcatgaaaaacaaagctgtgggaatagatatactctcaagaggaatgaggagtaagcgtgttaagctatctgtaagaacccatggaactccattatttaagcagtggctggagaataggattcaaaataagtcaggaagtatacacaaggcagaaggaacacctgcagagattgatgtcataggaaacaagaggaagtttgaagtagatcacagagttgttttctatgacaaaggctgtgaaaaaattaaacaaaatggaaactgaatacaaacctgggagtttgtctaatgagaggtgattgatgacattgaaattgacttctaataaagaagattggtaaaatatatgtgagtgaactaggtttgcagtaggttgtgataaaatggagtatgagaaaatgaagaagtgaatatagaaaacaccaagaatgctggtaagagggaaatttgtggtgaaacgaagaatttttaaattttgcaatttctttttcctcctagataggagctgagcaacataactggaacaagaaaacgatgaccatattatgaccaactaaatgttatgccataaaacaaacctatattacaacagcaggtctgcaaaggtattacagtgcaagacaaaacattaatatttgtacagtgcaatggtgtgatcacaaactgctcttgacggaagaggtctgcatcattttaactgtgggtgaatttataatcaaaggatttgttctttgtttttgtctttattttttatttatgcagtttagcccaagatgtgtctagaaatgtcatttttttaaatagcccactgaatgtattaaactgggatcaggcaatttggcctatcgtatgttgcatttcttcatctgattcctaatatttcatcagtataatgagtcatatacaggtgatgattatcacataaaatttacatttactaaaatatgagcataagaaggagaatagacacagccaggaagcactgtcaggatagtatatgatgttgtcacgtaaaattatttactaaagtacttcctgaaaattcaatcagcaatttgaaaatcagtcatttaaatttcaacaagatatcagggagaactgagtttcttaaagatgtgaagcacaagagggtgtccctaaacaagattaaggtatttctattagaaaattataatagaatatattgtaagcaaaaaataatacatataaatagctataggaaaaaatctaaatatatagtaatcaatgataacagcaaaggtgattaagtacaaatcataggaatacctaattttagtacatttagttattcaaaatacccatattttgttgaagttccctgaacataagtttggaaagacagatataaaatactaagaaatgtataaattggttactttttaaggaaggggaaaaataaagaggcaacctgataacaccacaacattctggagcaatgaaaatggctgggaattcatgtaggaatcatacgtttccattatgtgattaaaaatatgaaatacattacaggcatggtggttcatgcctgtaatcctagcactttcggaggccaaggcgggaggatcactggagcccaggagtttgagaccagcttgggcaacatggagaaagcctctctcaaaaatatgtatatatatttcatatgaaaatgaaagaacattaacaaaattatacattaagcatgaatagctactggtttaaggcagaagcatattaatattttaaataacgtattttaatttgcatggcaagaaaatcatcttaattatatatttaaattattttaaaatataaatgtatttaaaaatctaaatatattttgtaaatgtttgtataacattaaatgttctaaatataaaaataatattgtctttctatataaagtttaatttcttccaggaagtagtctaaagcatcttctagaggcacacacagctttataattttttaattttgtgctttatcatacttttcatttcatgacttctctacctgacatcacactcaaatatctagattagtgctttgcactctgtaatccttaacaaatacttttagatcaatttaatgggtactttgcaaacactgtagcctttgttcccaaactcagattattacaccaccatagagagtttgtctttgtttatatcaaccaaaattctatcagttctgatagaaaaaagcattaatattctctcggctggcattatttcctgaaagaattgtcctgagggatttagtaaggtcaaatagtagagataataatttattaacctttatgattaggtgtacacattagctgtaattaaactgtagaaaattaatactatgatttttaaatgagtaatataattatacatgaagatctatttgcaatatattcatatttagcatgttaagggaaacatcgtgtctgaagcattagttttctagttatttcactaacttcctctatgatcaaaaataactatttttaagaataatcacttataatgtcaattttatttctgtgcaagctatttttgttgtatatatataattattttgactttaaacttgattttaaagcagttttaattattttattgttataaactttattcctaaagtttattcctataaactttattcctaactgttctaaaataagatacctataaacacatgcacacagagttgagattaactggcgagtcatgatttatacctcaatagtaacccacagaagtaactgtgattggccactttcatattttcagctctgctgtttttgacctccattatttcaaataatatgcatttatttctgtctagtgagtgatttatcaagttggcattcttattgacttcttattataaaaaatagcaagaacaaattttctcatactgttctagtaccatgtatagtatacctatttccctttcctatttacttaacaaaattttgacagattatgggtatttatttaactaaaaatattcggaaattttacttcttaaatattaataaaatgaacattcttcatatggaatataccaatattgcttgacatcctgtccataatttaagatgtgcacatgagagtccctcttctgtctcctgctaccttccagttcctaccgtgtattgtgggaaatgacgaaagtattcaaggttattcattgaagttgtcagttgtaatggtaaaggcctagaaacaaccaaggtggctctctcaaagttgaaataaactgtgatactcatacaacatagagcactggccgggcgcagtggctcacgcctgtaatcccggcactttgggaggccgaggcaggcggctcacgaggtcaggagattgagaccatcctggctaacaaggtgaaaccccgtctctactaaaaaatataaaaaaattagccgggcgtgggggtgggcgcctgtagtcccagctactcgggaggctgaggcaggagaatggcgtgaacccgggaggcggagcttgcagtgagccgaggtcgcgccactgcactccagcctgggcaacagagttagactccatcccaaaaaaaaaaaaaacaaaaaaaacaaaaaaaacaaaatagagcactaagcctattttgaaacaagatagaaatgtatatagtaataatgttccgtgttccacaaacattgctaagcgaaagcaaggtgcagaaaagcatatgtagtatgtcaccattatgaggaaaataagtaaatatatatcattgccttttaaaataagcaaatatatactattacctcatggaaaaaggcagtaatgtatacttgattttttttacaaggattttctgtaaaggtccccctcaaaacataaacagtgattacctacaaatagcagaaaaaaaaaaaacagtggaaatttaggggccagtgagtttttttatcgtacatcttttttatatatatttattctgaaccatgcaaatatattagcatctgaaaaactactataaattagttattagttaattagccatagttaaaacatagttaaataatttggtgttcaatcaaatactttcttataaagcttcctactgtaggttgatcccaaaagtagggaagaaataaaagttgccttattaagactatatgaataatgttcacttcagaacaaagtagttactggttgtacagaaagagatattgaatcctacctaattgcccatcattcttccaaaaagtttatgataataattaaaataaattatgtttttattttcatgactttttcaaaatcatgctacataataatttgctattcattttgaaccacagttttcttgtacagatctttactttttcccaaagaatattattgccattattttagctttatgctttcactattactctaagattattagccctcttcatcatatttattacatgtgtaggggtgaaggttcactgaaactgaatagacaaaaagcaaattaataggaaaatgcatacaaattaattttaatgtgcatagcataaggaaattacagaaaaatgattacccagtaactcaatgtggtacagatgtgtataacgccttcttcataggggaagaagagttaggagaaatggggccgtctgagggatagtaaatgctttttatggggaaaatgaatagatttaatgctcagacaatggttaataaataatttctttggaaattaaattgaacagagagtttgatttggaacaaagtctgggctctaggtgtagggtttagttttcaatctcctcctctggaatatgagttttcatcttttctggttaatgaaatttcagagaaggcaactctgtttctctttagcatatctggtttctaggaaagtaagggaacttgagagaacagattaatcctgtgctcgagagagacaggtgattcagagataacagcagggtaggggagaggccagagagaccttgcaactatttctttaaccaaatttctgagtgaaatagtctcgtttccttcagtcccctgtttaaaattttattttcagaaagttgcacatattaaagtagggttggtagctatggatagagaaatcagggtagtaatcaagtggcgtgagacctgcaaaagaagaaaagaacatagattacactgagaatgagtacatagaaaagaactcatctaagcacttttctccacacccaattaagtcagttttatttctgagaatagaccagtccaattaaacagttgagtctcatcttaggagatggtagtgcagatgggttctcaaagctaggtctctatatatgatgcaggcaaacaaatctttattaagaggcatttctatggaaacagaaaaaaaaagactaatgtctggagtcatctataaactagtttttcaagtctggagggcagtcagttgcaaagatttttttatctgagctgaagcatcttcagttggaggagggcagacagcggcaatctgacagattttcctagcacagaagtggtccatgcacaagccatcacggtgacttctctggagtctatttattacatgggtgaccagtttcagtttgcagggctttaggaaaaaggccattttaattttagtaattccaagtcagaagggtgggagagaaattgaaaatgtttgtttggagattcatagcccaatattggaggaaactgaatattcaggattaagtctaggtaatttaaaagaaaaaaaaactcaaaagcaaatgaatcaggctagaatttagtaacaagtgcactatagtttcttttcttaggttcattctaaaattaatttatttctttatttatttgtaattatactttaagttctgggttacatgtgaagaaagtgcaggtttggtacataggtatacaagtgcatggtggttttgctgcacccatcaacccatcatctacattaggtatttcttctaatgctatccttcccctagcccctgatttcccaaaaggccccagtgtgtaatgttccccgccctgtgtccatgtgttctcattgttcagctctcacttatgaacgagaacatgaggtgtttagttttctgttcctgtgttagtttgctgagaatgatggtttccagcttcatccatgtccctgcaaaggatatgaactcatcctttttatggctgcatagtattccatgatttatatgtaccacattttcattatccagtctatcactgatgggcatttgggttggttccaagtctttgctattgtgaacggtgccacaataaacatacgtgtgcatgtgtctttatagtagaatgattaataatcctttggatatatacccagtaataaaattgctggatcaaatggtatttctggttctagatccttgaggaattgccacactgtctttcacaatggttgaactaatttacactcccactaacagtgtaaaagcgttcctatttctccacatcctctccagcatctgttgtttcctgactttttaatgattgccattctaactggcatgagatagtgtctcatcgtggttttgatttacatttctctaatgaccagttatgataagcattttttcatatgtttgtcggctgcataaatgtcttcttttgagaagtgtctgttcatatactttgcccactttttgatggggttgtttttttcttgtaaatttttttaagttcttaaggttctggatattgccctttgtcagatggatcaattgcaaaaattttctcccattctgtaggttgcctgttcaatctgatgatagtttcttttgctgtgcagaagctctttagtttaattagatcccatttgtcaattttggcttttgttgcagttgcttttggtgttttagtcatgaagtccttgcccatgcctctgtcctgaatggtattgcctagattttcttctagggtttttatggttttaggcctcatgtttaagtctttaatcaatcttgagttaacttttgtataaagtgtaacgaatgggtccagtttcagttttctgcttatggctagccagttttccccaacaccatttattaaacagggaatcttttgccattgcttgtgtgtgtcaggtttgtcaaagatcagatgttgtagacttgtggtgtaattttgaggcttctgttctgttccattggtctatatatctattttggtactagtaccatgctggtaccaaggctacagtaattacaagtttcttttttttctgaaacaatttttctctctctggtttccccatttttaccaaagataaattattaataagacaaatttatttgcaaaatgtttcatccttggcctaattatttgcatacatcttacaagactggtgattgttcatatagagtctttttaagctggctttgctggaacttgttcatcaggaatttcagattagacttttaaaagtctctcaaagctggaaagccaagccaagaatttgacttgctctcaaactttgtaatacctttatgaattgggtgaatacctctcttcttgagatcccccaaaatatcttcagattcctgggcctgccaggaagtgacattctttacccaactctaagacaaccatgtgagtcatacatttaaggtatcagaccagtttttcccaaggagatttttaatggctccataaatttaactttaatttccaaaggcagtctggtcacatctgataacatgacgttccagtcaaagccttggtaaaataaccagtgttttcaattatgtcctcttataataatataaaagagactcttattaaacttgtgtaaatagcgtatttccatgaaataagaatactcacaaacagtttctgcttctggagggatcaggtagagtgaaaggtaaatgttttaattttgctcacaaaagcatattttacaaaatttctgtaaagctatagatagctgaagagagagacagtgagagagacagagaaaagaatcgggaacattttaaacaaaaaagtcataaatataatttcattccttcatcagtttagttccatttcattaattattgttttgtttgatattgggttagtgattttatgagtctatgttcttaaaattaaagttctggaaattttgacccagtctaatgacataacctcataattgtcaaaaacctgtatttctgtatttgttacagatttttttttctatccttactatgaacctccttgaagacaaaatacttcaggatttgcaaaaagcattcagaaaaaaagaaagtaccacaataacgcaattacttatggacaagacctaaaatggccatggttaaacatgcaattaaaaatcaaatttggttattttaggtgtcttaccacaattttatataataattataattacgactaataacatataccaaggcatatcaaaattttaagaatctcaaacaaatttggaacacatattaataaacattcatataaatatagctcaaagaagagaaaacatcatttcttatttgacacttcctatataatttaatacataaaataagcgtgtttcttatctctgtttcacatgcttcaggggcctctggatcatgctaaagttaggttgatgtcaaaaagacttaattttgattttgaaatatgattttgggaagactctcaaaactgtcaaaggtttagagcatttgatcaaaataaaatcacagatcactataaaaaaatagtcattcatttagccaaaataataaataaaatatttcaaaacgcaaaaacttttactctttgatagagtaaattcagtttttaaaataatcaaaagatctaataaaaacagcaagagacacacagaatctttctctttttctacccctacctttttgtgaagtttacaacactttttacttttataatattaaaattttgtcttgaagaaaaaatcaaattttagttttatatcagtttactattaaggctaaagctaattttttttcttttctttttttttttttttttgagacggagtcttgctctgtcaccacgctacagtgcagtggcatgatctcagctcactgcaatctccacctcccaggttcaaacgattctcctgcctcagcctcccgagtagctgggactacaggcgcccaccaccacgcctgactaattttttgtatttgtgtaaagatggggtttcaccatgttggacaggatggtctggatctcctgacctcgtgatccgcccacctcagcctcccaaagtgctggaattacaggcgtgagccactgctcccggccataaagttaattttaataaaaccttgtaaacaaatctgtcaatctcagtcaactttgactacacacgataagattttcatcaaccttttatagtctcttaaattttttaattctttttccccctactgcttataataatctaattttatctataccattgtatcttttttttattttggaataacttttagatactctttaacctaaacaaaattactgttatttaacaaaaaccacatcctcataccgtataacattttacttttctcatacactctgtatacagaactgtttcttacatacagtagttttaattatatagatctggggtcttcaaaccctgggccacagactggtaccatggcctgttaggatctgggtgggacgcagagcaggaggtgagtagcccgcaagggagcaaagcttcatctgtacttacagccactccccttcactctcatccttccctgagctctgcctccagtcagattagcatcagcattagattctcatgggagcatgaaacctatcgtgaactgcacatgcgaagaatttagcttgcactctccttgtgagaagaatctaggttgcacactccttgtgagaagattccaggttgcaggcttcttgagagaagatcatgcctgatgacgtatcactgtctcccatcatcgtgagactgtttagttgcaggaaaacaaggtcaggactcccactgattctgcattatggtgagtcgtatcattatttcattatatattacaatgtcataatagaaataaagtgcacaataaatataacccacttgaatcatctccactgccccggtctgtggaaaaattgtcttccacaaaaccagtccctggtgccaaaaaggttggggaccgctgacatagattagttaaaattttcgctcatagtagccttaatttctagtaaaactgaggaagcaaataattctaatttttagactttatgtaaaacaatttttcagtgtggaacagtacatatttactaacaagcccagatatataaacttaaacttctgtagaatatgtttcagtattttaacttacttggaaatgactcagacatttcgtgattgtctatcacttaatttacacgactttaagattgtataacactgaaaagatttttttaaataatagaaattacaatgattatttgatttgtattccattatgtaataataatttggggttcaatcaagtactttcttataaagttttctactctaggttaatctcaaaattggggaaaaaacttatcttattaaaagtgcatgaataatgttcatttcagaacaaagtacttagtgataacagtcctaaagaaagggatatataatcaaacctagttaaccattcttccaaataagtttgagataacaatccaaataaattatgtgtttttttatattttcataaatgtttcaaaatcatgctatttattaatttgctacccatttgaaccatggtttatttgtatagattcttattctcttcatttatttcccaaggagttttattgccacattttagcttatgctttcactattacactaagattattaacgtcttaatcatatttatcacctgtaatccacttttttcttgaagagctgctttcaagaatcttccaacttcctgcttaaatctatagatattattaattctgcttactgtacagctatatcttgatttttttttgcattcctggattaacttcactgtttcttaaatcccatagttttttgttttttgtttttttttccttgaattttctggaccacttctcccacccttttatgttttcaaaaaaaaaaaaatcacatgggaagtacaattttcagagctttgcttacttgaaattttaacaatttgccttcatactttaaaattggggtgggggctgtgttagggagggtccaaaaagaagaagaaaatcacatcagctattcaaaaaataaaataatgtcaaaaaattatgcattactgaaaaggcaaataaaaaaaagagagatgatagaagtagtaacatcagtaaggagatatcatctctagggctctgaggtagcaaaggatgctcaactggcagctcaggaactctgagaaggagcctcatagggttaatcccagacctcaggaacttaagagaggtccagcctgtgagtaagcgcgtgtacgaagggatgcaatagactgggtctggaagtggtggaaaaaaatgcaaacaaaaagctgtgctatgggcagaaaaagcacagttggggatatgtagctaggaacattaatcaaacaggaaaaagcagtaccctttgttatatatttgcgtgtgtgtttgtgtgtttgtttttggcaggtgagtctccctctagcatcctgtattgtgagagattaacaaagaatccaggtggcaagggaggaatatgatttgcaagtccttgtcccaacatcataaagcagagcatagaataatggcttttgaaacaagaaacttaggtttcctccgaattttaaagggcttattgcaatcactcatggtgggaagatcatcccagtgaaatctcatttctctgtggtaaacttttgtgggaggaaattactgttctttctttagctgttggaagaattttccccacctagaattattttttacttatcctaagtattctaaaatttatatttaaatttataataaaatgtagaataattttaatattattttgaaattgggaaattttagattttatagataatttattttttcccatttttcttttctctctcttttcttttctctcttttctattagttaaatatcaagcttcctggattgatgtgttttgtttattttgctgtcatattttcgatttctctctctctctctttctgtgtgtgtgtgtgtgtgtgtgtgtatgtgtgtttaagagacagggtcttattctgttgcccaggctggagtgcaagagcacaaccatagctcactgcagccttgaactcctagcctcaagtaatcctcccacctcagcctcccaaatagctaggactaccggtgcatgcccccatgcctggctaattgtttagagacaggggtctcactatgctgcccaggctggtctcaagatcctggcctcaagtgatattcctgtctcagctttccaaagtgttgggattataggcatgagccactgccgggcttggcctctgtttctttttgatgagtgcatattctggattttcttcaatttaacctttaggattccctcagaatattttatttccatccaatcacacgatttttccttgttttctgattgcttatatttactgacagccctttttataaaaaaaaaaccttactatttgcttatttttgtttatcttattttaatttctttcaggtgatgctcaggattcttacatgttttgtttgatccacaaataattaatttttttcttttcaaatttttctgtttattcatgttagaccatttcttttgtattcttaatgctcctaaaatgtctagtgatccttatttagccattcatgttttaaaataaagaactgagtcaattaacataagtaactgatatggatatcctcttctgttgtgaattttagcttcatatcctaattatcttccataaaaggatcacacgctgggaaccagtaaacttgtctttagtatgtgtgtagaaagtaggctaggacctctctcactaaatgccggtatgtagaggatgatattcttgcacgccaacatcaacactaaaaacctcaactattcccaggcagatcgtcatacttttttagaaaagcaccatctgttttttgctctgtatgtatgccaggtttccaatcactctcaacaactgagttttcgagagcagtgtgtagaggagtggtccttactgggaaatttcttcacaggcatttcttcagataaccttcctgtttttggtcgtattacccacttctattctttgttttgtaatctctgtttggagtcattgggaagcaatattggataaatcagctcttatattcactataaacttctgaactggttttgaatgttgacaaatatccacgaagtgctatctctcaatatcctcctaggggcttttcatatgttagaaatgcatttctagacctcacacaggatgcaaccagaaatccttccccgctatgcccttggcaactgaggttggatagataacagagctctgcccattatgaggaaggcaggagtctgagagtggaacttctgggaaaggttgtactttattgataaaatggaacagattcaggtaactcattatcccttcctctctcccttcctccctccctcccttcctttcttccttccctaaagggaaattaaattcaaagaaacagaaaccattttagaaccatgaaaattaaagcaaaaattctgaggatggcagagcaaaaaaggagctgagactctgaagtcattgtttgttgagcaaccacagtaaccatcaactgcctaccttcactcttattaagaaagaaaagcaaatccatatttgattaagctactgttaacttggtttgctctataactggtcaaatgcatttttaactgttaccagcctgctcctagtccttcccaacgtcagtcagcatgtttgctctttgatatgaagctattctgtttagaacttgtttactattattcaaaggtggcattgtgagaaaaaaaaaagtcatacttctgcttggtctgccacagaaagctggaaggtttaaaatttcataggagcacacttttgccaaaggaaatggacatgacagtaagcattatttattggaaataaaaaaatcaactagcagttgaatatccattatgtataataatctgtattagaaagcaaaactataaaaattaaagcatttcctatgtattaaaaatgtttagggactgagataggataactgtatatatgtctctctctatatataagacatctatatatctatgtatatatataggatatctataggatatgtatctatcatctatctaataagatgtgaactaaatgaaaaaatcatttaatcatgcctaatattaatatggcctaatattatctagggttcattgggtgggacagagtggggttggagtgtgtggtggtatggaaaagaattactggggttggtgatatatgagttgagagttgcattttccagagagaaaagccaaaggaggataattcaggaacacagtcaaactgttgcaaaataatattgttaaatcaaaatatttgggaattggagtgtaaggatttttatctgatatgagttctctgggttgttgggttgtttcattatgcagccaaatgggaaaccactatagaaggagaatggcgtggttgtatttgtgttttgtaaggactactgtgacagcatggagggttatatattgcaagtgggcaaggctgtgaacaaggaaatcagcttgggttaaattcaagtttgaatgtttcttgccattttcttggccagtggttctcaaccaggagcaattttgcaccctggggagtattggcaatctctggagacatttttataagtcacaatctaatagtgtgatgggtttgttactgagatccagtgggtagatgatgatacacaggtcagtactccacccccaaacaaattatcggaccctaaaggggaggctgttggcagactctgacataggcaatgtgatagtcacagataataatagagaatgttatgacagggaacaaaatcactgacagtgtgtttattgagggaatttggtcaaggaaggagttctggataccacacctaaatatatattgccaaaggaagacagtagaaggaatatcaagaaagaacaagatggggaaatcaaaactaacagacttctcaaaaaatgctgcttcaaacactagagagacgaaaaaaacatgctatatattcccattaggttggtgaactttgaactgaccaatgatttgccttaaagcaagtttagtaggcagttaaaaccaaatgtaatggtcaggggaatgggtgaggagttaaataagtatgagcaatatgagggagcttcacaaggtttacagaaaaatggaattaaaagtaaaataaaaatacagactttatttctcaacataagctccatcaaaatcaagacaattttgtaagtgatgatacccgccatttagtccatccttaaagaactgaaggtcctgggaatttaaccatgtcaatgtagccttttttacattattaactgcaaaagtgtgcccttttccaacaaagaccagaaataattggaggaagaaactacacgagtttctgtcattccagggagagggaatggcaagggcaacagcactaagataaaaggatcctttgtgttcccaactgtctttaaattttcttctggcttttcatctagcactacacttgtctagttgttggaaacttcaaatcatttttgaaagaaaaatgaatgttcattgcatgctgaacatatctaggaattaaaatctctaatttatgtatgattatcagttacgttggttagaacacgatacttaaatataagaagtttcaggtttggtctttgcatgaaaccacgatcattttctggtcactctctgcactgttgacactgtccttaaaatataccctaatgattgttaacagggagtcaccaagagtgttggcttggtgcaaatactactaccaccactgaaagaggcaattcatattgtaagccattctcatcttgactcagtaacattacaggcacacaaaggagatactatattagcatactcaacttcagaatctgcactaattttttatcatcatttattccatatcaaaagtagtttaatggtggtttacactagaactaagaattatattggttacttggctccttatcaggtagttatgttgataaatgaaattatttccttccattgatatattctactttatcacaaacattgttatttatttgataagattctatgtgcaagatgtataatgtggtagctaacacatagctggcccttaatgataataatattattatgaatccaagctccagagagcagaatttctgcctcttttattttctgttaactgagtttcagttgcatagtaggtgctcaatacataattgttgagtgattgaatacacaaatgaaaaataatagctaatatttgaagacacagacataaaacatacaaatatagaatagttgagattaccatttttaaagaatgaataattttaaaattaaaaatataatcattatgccaaaaggaaatggtaaagctgtatgagaaattccattctattaagcaaaaataattattagctataattaattgaatgtttatcatgttccaggcatagtgtaatgtgatttacataactgaaactctcacaataatctttcaagttggcattattatctcagttttacaaatgagaaaatacattgaaaaggttaaactttgtgcacaaaggaaatgagttttatgatgtccaagtcattcctaagtacaataacctggtgttttcttctgtattaaaccttctcaatgacccaaagactccatcctctttttctgggaacttacgagtcctagctcatagtatggaagtaggagggtggaaattcagggcaattagaagattcattaaaatctcggggcacaaatacatacccttaagttagaccaccaaagcaagatgaccagccagcttttgctaaaaacagctaattcagcacctcagtaaaacatattgataggctcattggaaaacgaggagttggttttcacattctaacccatcttcctggatgaatgttctgcagtctctattgggcttatgaactcctcagactggcacttgtagagccagtttcccttttctccacactcttcccacttctaatcccaagaaaatgcttccttttccttccttacaactctaacccaggttaccttcctctaggatccaggaatcctgcctgggtactttgaccactttctatgctctttccaatccatagctataaagtagactataaattcagcttttctcagagcctactgttttgaatagcaaacactcattggggagcctaatactgaaactcacctatacgtttctttgcattactgttctaacattctaattctcactcaggagatttggattctgctgacgagagagagagagatgtattaaaaagtgcaaaaaataaatgcttactggtatcttattttgcacttattcaagatcacctacatttctctgaggtcaattgcagacatgccattcaaacttaataaaaatctgcagttcataaaaccatttaatttgcctctttttttgtaattattttggtattatctagagacagtctttgtttaaatttgtaatttaatatactctttgaatattttgagattttaatttattttaaaacaatttatattaacatttattttaacttattttacttgattctaacttaaattaacaattatatattggctgatgattaaacatcagtaatttacttcattatttgtttatttttataccttttgaaaataattcctaaagtattttaaagtgagttgaaataagacacaaaaaatcaaaaccaggtttaaaattaaaaatataattaaaaagaatagacaatactgaacaaatcctagtcttgagtttctgagaaatcatggtaaaaagaaagcattataaactatacagttcttattgtttaattaaaaggaatatatctgttttataaaaggtgaaaaaaagtcctgactttggaaaatattaatgaaatatcttctctatgaaaacttcggttgtaagcagtagtttgcaaaataattaaggaggaatttctacatggtcttggggaatatataacccagtggagatttactaaatttattcgaatgtaatttatttaaaaatagaaagctaggatatgtcttcaccagcagcttctcaatgctacagacgcttattaactctcttatttcttacccagataacaatttcaatgacaaattaatgtagctcaacgtgaagaattcagttgatataactttatacatgagagccattcaaatgaaaagaggactgtctagctggtcttttaggccaagagttgtgacccctcaaagaaattactctgatgttatcttaattctagccataacattttgtacttagtgtggatgatgtcaggtgttttactgagagtagttggctcacaggaacaattgagaggtatttccacacctaataacaaggccaagtattcaacaccagagatgtcagagatgtcaggcacctgagctgcagacagagctgagctgccatgtgtcagctaaagcaacaagaggccaacatgagagtaaacagtgaagaccttaataattgtttactgcaagagcatattcaagagtttaacactagagaaagtggtgattccctctgttacattcttactctgacacttctcgctagggaatgatgctcccatagagggtcagatagatcaggggaggtcacctcactgtcatgggaacttggaacacaaggctcctgcagtttaatggacttggggcctaagaagagggagagatgtagggttaggagtggaaaagtactgattattgagttggagtgatggggaaagtatcttcaaagtttctctctcttcagcagaggaacctgaagaagacctctggtcaaggcctaagataaggagacctaggaataaaggttcatgggctaggaaaacaaatatacataaaagtatggttggccaggggacactgtgtccttgttgcaactccttctagagagactgcaatgcacccaccggctaatcacccagtgtggtatggggaggccagctttccctcatgagacctgccaggtaaattcttcagagttgctgatgaccaggcctgaaaaaccacacataggtttttaaccggaagccagaatttttaggaagtagctactgctcttacatgctaaggccgacgattttatgtcgtattaatctaaaagctgatttgaattatttctgcaagatggattgctaccagacactatgtgagtctaaaggcattcataaaacataggtttactatgtttaatgttatcttaatggaactatatatatattttatagtattttatagttataaagggatgtacagtcactccttgcctattctccagttatatcagcccttgccctgaataaatcctattacagcaatttaagatatacacacaatctatctgtagacaactttacttttccctgcagtctgctagagaaacaggtacaattctggcttcatcttgagaacagcaggatttagataagctttatggaggctgagagttcctctgtagcctgtgagattagcagtaggctaaagaggatatctgtgctagaagaaaaggaatcttctttctggaaagcagtcctatacaaagttacggtgatctgacctggagtctcattttcaaaagggaggcttgcctgacattcctagccagttggcattagcctgatcccctcttgggcctccatagtccagttatccaaaagcagatactttggggctacaccaaaaactaggacaggtttttgtttttttcttttctttttctctttttttttttttgagaccagtctcgctcttttgcccaggctgggctgcagtggtgcaatctccgctcactgcaagctccgcctcctgggttcacgccattctcctgcctcagcctcccgagtagctgggactacaggcgcccaccaccacgcctggctaatttttttgtgtttttagtaaagacggggtttcaccctgttaccaggattgtctcggtctcctgacctcgtgatccgcccgcctcggcctcccaaagtgctgggattacaggtgtgagccaccgtgcccggcctggggcaggtttttattgaaatttattcagagccattggtggaaaaagtccctgtgaatgtttattaatccagagtttaatgtcaaagtttactaagacagagaggtaagaggacttggtagttaactcaagaaacatcgacttaaattaaagggaaaaaagtgcttactgaaagatgagataaatcagcgtctggaaattcagagggaaacaaggttgtagtaaattggaggctaggaaacaaaagtagtacattaaatggggattcgattataaagcagcaagaaacagctgctttttcattatttgaaataatgaaaaagatttgaaagattatttgaataatctttatctgtatctgagtacaatcttctacgtcatctgtattttagatctatgagttttaaccatatctagctggagactctggctatatcctataaatatttgcatatattagtcataagagtgggttgatagtcatggctaatgagtagaaaaactccctcatgacagatcaaaatgctaagcccttgcattgcatatttgtggcatgcaaattcatactaccttgaaacgtagaaaactcatgctgaaaataggtccagaacagtgaaacctaaaagatcctggtagatatggatgtgaaactgtttctgggaatacctccacaactgatgaatttcataaaaaacaactgctgtaggtattctaaaattacaaagctcatatagaaacaaattgccttgaaaaagtcaacaattacaaaaagtcataaatagtcacatggattatacaatagcaaatgcaaatagattgccaataaatgaaatttaaatgttcaaagggaaaaaaaagaagaaaaagaaacctaatgtgaatgtcagatcattattaaacagaataacaaatttataaaaacaattgagtaggaattctagaaataaaaatatgatctttaaaataaaaaaagaacatatgaagggttcaacatgagactcaatagagtaaatgacttaactaatgaattggaagacagatctgaggaagtataaaataaagatataaagacacggaagacatgaattagaagttaaaagtgaaagagaagtaaatgaaatgctccaaaatcccactagtgagaattagtaaagaagagaatagagcaaataagagtgagaaaatatttacggagataacataaagtttttttttaattatagaaactgatacgctctcatatttaggaaaaacactctgtcccaaaaaggataaatacaagcaaagccacgtgttggcaccttatggtgaaattgcattgcattgataataatcaaagaaaaaaaagagcttctaaagagaaaacacagattatctacaaaaagttataaaggggcatcaattttttattagtaaacaatagattcttaaatatgatgaaataattcctttaaagtgctcaactaaagaactgtcaactatatgagaaaaactcattcaaaagcaaacatgaaataaagaattttttgagacgacaaaagcataaatgttacatgttgaaataagcagcatgcaattgcatctacatgttcaatagagaacaagaaaagagtgagcaaaataatgtttaaattatttggtatttggtaaacttgaatataaatcataaatttttaaaaaatgctaaaagtttgaaaacattataatatggaattgtaaaaatgaaagttggtgctgatactttggaaaaaattggcaatagtaaagttaaagattaatatatctttcaaactacaatgtaacttcttggtctatttgggtgttaaacacagatgtgactaagaaacctctacatgttccagataaaagaaaatgacacagcaaaagggttcagagagtggcttagataagcaatagtaggtaatgagttcttgttttctgaggcacgactcaagctcactttttaattttctattcaacaataaaaatacagtttggtaatattttgcatacaaaattttaagggtcaaaattgtaaaatccacctcaggtttccaggggagaagctctagaatagagggtttagtgattttgcatagaggttgcctgtaaaatcctgttaagtagagaatcaactaaaatatctttgtgataggtattatgtatttctgaaactctttaatctatgtaataaacatgtccatcagattggaattgatatcctaggtaatagatactttttctgtaagaattctattttgttttggagattttgtgctatattggtactaacatgtcaaaggaaatatagaaccctcttgagaactaatgaaatcaattgaatatgacaggaaattatctatttcctggatgactgctgaccctccaagaaaatctagtctttaaatcaatattaaatactaaaataaataagattctgtgaagtattggagcagtacagttaaatatattgttgatctctccaactaaaatcaaagagacatctctaaaaaaggcagaccacaggccaatagtgaacaaaaaaagggaccaactatagtgaataatgtatcatagggtggatataagaatattattttgttaaatatcactagtcattttgtgtttttgtttgtttgtttgtttttgagatggagtttcactcttgttgcccaggctggagtgccatggcacgatcttggctcaccgcaacctttgcctcccgggttcaagcgattctcctgcctcagcctccctagtagctgggattacaggcatgtgccaccacgcccggataattttgtatttttagtagagactgggtttctccatgttggtcaggctggtcttgaactcctgacctcaggtgatctgcccgcctcggcctcccaaagtgctgggattacaggcatgagccactgtggccagccgatatcactagtcattttgaacaactatatggattatggcttctcaggtcttatacaaatgactatcctttgtgttttgacttctttactagaaggtggagatatcacaaaacctgtatgtagtagaaatattttcaaacaaaatcagataacttattattcctccagttcctgtgaaagacattggtcctcacaaacactgcaaaaattagtagtaatgtttaaaaaggactacctgaattgtgacatctattctgcttgtatctataaaactaattggctattggttctaataaggagtcaccatggaatactatgcagccataaaaaatgatgagttcatgtcctttgtagggacatggatgaagctggaagccatcattctcagcaaattattgcaaggacaaaaaaccaaacaccgcatgttctcactcataggtgggaattgaacaatgagaacacatggacacaggaaggggaacatcacacaccagggcctgttgtggggtggggggaggggggagggatagcattaggagatatacctaatgttaaatgacgagttaatgggtgcagcacaccaacatggcacatatatacatatgtaactaacctgcatgttgtgcacatgtactctaaaacttaaagtataattgaaaaaaaatagtaagctggtgtaaacagatgtctgtttggttcattaatcatttctaagtaaattacattgacttttcaataccatttgcctactaaatctttctcagaatagtaacatggatactgtcacatggaagaaaagtaggtttttagtcaaggatctagtagttacataagtattcaaagtccagcaacttcaagtagctacaaaatattcctacttattcatgctctttattactctggggaaacagttaatgtaaactgtcagggtatgtgtttgaaatagtagcacctatatttaaatttacaaactttactttagatagttcattttgtgtgtctaggaaaataaaacatatgagtgtcattgcaaccatcactgaggttctaagtgagcccctcatcagttagcatttttcacaagttgtgcagaataagaaagagaagaaaagtcttgcactaggtagggttctctctataataataaccaataggtataaagagatttactataaagagttggctcacatgattatggaggctgagaactaccagaatccaaggtcagaaagacccaggagagccagtggtttagttccagtctgaagacaggagactgatgtctgtaagcctaaacagtcaggaagtcaaaattccttcttactcagcctttttgttctactgagtttttcaatttattgggtgagtaaagcagaatgctctgctttactctgtccacatattaaaatgccagtctcatccggaaacaccctcacagatataccacacaatttttgatcaaataactgggtaccttgtggttcgatcaagttgacacataaaattaaccattacaagtatcagggggaaaaggaaagcggaggtgcaatagaaatttgaatttggggctgggtgctatggctcatcccagcactttgggaggctgaggcaggcggaacacctgaggtcaggagtttgagaccagcttgaccaacattgtgaaaccccatctctactaaaaatacaaaaaattagccgggcatggtagcgtgcgcccatattcccagctgatcgggaggctgagtcagcagaattgcttgaaccgaggaggcagaggttgcagtgagccaagatggcaccactgcactccagcctgggtgacagagtgagactccatctccaaaaaaaaaaaaaaaaaaaaaaaaaaaaagatatttgaatttgggaattttgggtttttctcatattatgtcatttaattttttcaggaaataaatttaaaattctatatgaaattctcattgactttttgagaattcactgaatcaatcaatgaaagtatcagagattttgtctcttttagttctaaggctctcatcaatgaagaattttgttaaagccaaaaatacgaacatggaccattataattttttttcttgcataaaagaattgtactcagtcaaatgtagcaagtattgtaattgaaatgagtgtatatgaaatgacaacattcacagcagagacttggaatggtcctagaattggttgtcctcagagttgtctaagagttgacagagagaagaaaatatgatgaagccttttcaacagatgaaacaagataatagcatggcacagtatgtgacacagggccatttgttagccattcatctgaaacatgactaaaataatataaacagtagtctgaatgacccagttgtaaagttgtgaataactctgtcaacaaaaatttttgcattcccacagacaaaccactaaataaagacaaatgtcaacctctcagcaattgcctttcagttatgaagaataaatggctctggatagaaacaatttaaatggctgtaaaactgatattaaccacatggctgagaaacagaaagcaaagctcccatttgttgcttggctggaacatcccaaggcagatgagatttgcaggcccagcacaaaaggcctcttagggacatgatggatcttagtccattggcttcactggttaaaatgtagcatacaaatcttggtgggatctcaagaaaaacagttaaaagggaaataaaatgcttataagtatgtaattttattaaaacaagttgttacttttataaaagacttctgaaataaagaacttgtcaaataaagagaatgatgaaacttaacagctaaaatttgatcattgattggtgagctgttcctgtctctgggaaggtaaaacagaatattctctttcttttatgagttatcttggactctagaacttttagaggttcccctttatcttttcttttttggttattttggaaggcaaggcttataaaaatataaaaccttttttgagcgatgttatgagatgggctcaatgttggatacagctaaggcaagaataaaaatgttagattatcttttctcttttttgaataatttaatgaagatgtgaattgttctcaacagctgatcatatgagataaggaaataaaacgtggttaaaaattatcggaggccatcagtatagctatcattacatctgatgttgcatcaaaaatcttttaaagaagataggatgaactgtggaaaaacctgtttggagaaagtgataatagtactttcacaatatttagttagtcagtagcatattttaaaaattaaagaaaaaagtgcacatatttcaggatgtgctatattagccaacaagcattttctgccaacaatcttcctagagagttgtcagagaaatctaaccttacaaaagctgccagttatttataaaacagtggcttaaacctaaaggataccttggttgtacagaacagactccagattactattaataaatgctttctatgccgaattccatatgatcaaaggaatcagacacatgttttgctgattgctgcatacctacagaaaggatatcttaatgttaaatgttgcagatttggatgatacatttgaatctctggatatactgacacccataactcctaaaagaaaacatcaggactgctgttcattatgaagcaactcttatgttctgggcagaacccacggaagagaaaagaaaatggagctaacagttcatttgttttcttgccttgacatttttcaaggaaacattaaaaaaaaattttaggagtagtaatctcacttaattttggcaggatatattcctatactaagctttcctcttggtggttggaagtcccatttggatcttcaaagagccctcttctcacaggcaatcagcatcattagataatcactcaaggaattttgtttcagcagcaaaagaaaatttccaagtaaaattacttaggagaactctggaataaaataaattgaggttttctcatattttaatttttctaaaaacatatttgtaagaactttcactttttggcaataatacagaacagaccacccagcccggtcttacaaatttatactatcaaagatggagaggaatgatgcaaatagcatctatgttcatgtcaatactacatgattaagtaaagtgaacatcttttgaaatcagaatattgttttcttttagatttctgataaattatttttagttttattttattttgaagttttactaaacattaaaaaatcagtacagaaaagatgagcttaagttaattgaatgaaataattttactgacatttttctgtctgatatgagaaacttagcactttaccccttcttttgtacaaatttttactataatataaaatttgagattttagatttacattcctattcactatgaatttttattttaatgattattttttgaaattgcatttttacaactacagtgagatacttgggggtaattttctattttaggttttctgctaactgttcatttgtagtactactacttatatacattttattttttgtaacactttattttttggagcagttttaggctcacagaaatattgagtagaaggcacagagattgcatacatacctgctgcccctacagctgcacagactcaactcttacattatcatcattcttcaccatagtggtacatttgtcatgtttgataaacctataattaacacattatgatcaatcaaagtccttagttcacattaggtttcactctgggtgttttatgtactataggcttgcacgatgacatgcacacactattaaaggatgagactaatttcactgtcctaaaaatctttgccatccattcatcctccctgtgcaacccctggaaaccaataatcttttaactgtcgcctgagttatgttttttccaaaatgtcatatccatccagtatttagccttttcagattagcttctttcacttagcaatatgcatttatggcctttccatatcttttcatggcttgatagctcacctctttttagcttaataatattccattgtctgaatgtactagagtttatttatccagtcacctactgaaagacacattggttgctttcaattttggcaattacgaataaagctgctataaatgtccatgtgtaggtttttttgtggacataagttttcaactcctttgcgtaaataccaaggagttcagttgctaaatcctatggtaagggtatgtttagttttgtaagaaattgccaacctgttttccaaagaggctgtatcatttttgattcccatcagcaatgaatgagaattcctgttgctccacattcttgtcagcatttggtattgtcagtgttctggaatttggccattctaataggtgtgtagttgtatgttcatgttgttttaatttgtatttccctaatgacataatgctctacatgctatacattaaatatttgtgttcccccaaaatccatttgttgaaattctaacacccatgacgatggtattaggaagtaggatctttaagacatgattaaattctgaggctggagcctttattaatgggataagcactcttataaaagaggccccacaaagagattccttacccttttaaccataagatgttatagccaaaagatactgtgcatgaattgggaagtggaccctcgccagacaccaaattttctgatgtctttgatcttggactacccagcctacagaaaaatgagaaaatctgttgtttataagccacccagtctgtgctttcctattatagaaaacaaaacagaataggacagtgcatttttgagttctttattttgatacacatttcaccgagaatatataggtaggtaaatttcttgttaagggtcttagcattttttagaatgtcttttgttttatttgagtaatagtggatctgttatgcactgcattcaacattttttatgaattagcaagaaaggttttatttcactagcctcacattctgatcccatttttctcacttaatgaatttatgctatagcattatataggtaagatattatttaatctatcagtgattagcatttttcttatttagatggtattacataatagcacagggtataaacacctgaaaattacacagaaaataacaagaggagcaatttgagcagtaaaaacatatgtactatgaagtaactgtagtattagagaaaaatagttcttaaaatcagacatctttatttctacttctttttctatagacagtacaatgactatataaaatgttacaatgcacatatagatctgagttaagcaatgtctattatttttatttttaaacattttgtcattttccccaacactgtgaatgctgctttgaattaaacatttcagtagaaatcaaagacatgtttatacagcttgagctgcaacagtttgccttataaaataccttgcaaataaataatgatatacatatttttgcctaaactcttcaggaaacgcattgagatttaaagctcctttcagacaatgaccaaagcagacaagaccctctggagtcctctattttctgaagtgttccagcacgatgctttttgatgatcagctgtttccctgtgtgttgagcttaacttgttgggttgtattttccttgttaaatgtcgaactttttattcgtttacttgttttacaaacaaaattacaactactcaatctcttcaattttgacaatgtcttaccaacaaaattataactactcaatctcttacttattgaaacaagacaaacaaaagaaaacagcataattgaagatttagctgaagagaaagtaattagaaacatgccaaataatttcatacctaaatcaaagaaatgccaacgtgagcatgcacattgtttgtacagttaaagcttctcttcataatttgaatgcagaaaatacttatgagggtttaaaagggatgaaagagccacattcctttgactaataagcttgtttataaatgaaagtcaaatttaaaacaggcatttttgttagaaaagatgctgttttatgcaaggttacaaaaccgtaagtagttatggtcagggctcttctggagaaagaaaaattgggagtcaatttggaaatataatcatccttcctaataagaaaatgctgtcatcagaagggtataagtcattcgttcctcatcatcaaaatctacttgccttaatttatctgaaccatgccagcaggtatatatctatagaaataaagggattgaacaagttgtcaacttacagctttgacaatactgctaatcagaaactcagcaagctctactgtatcatgcttcaatcattggaacaataaagaacccagagctttagggtatcacaagaaaaatgtcagaacaagttatacgtcggcactgtgaggcccagagattgacaatttaattaggattaatggtaattgtttttaaaagaaaaaatgaatgctcagataatttccttggaagttcaaacacaaataaacaggacaactttactgtttagatatatgattctttttattatacaacgagtataaaactgaggtgttacatgagacctgcctgctagagatagagataaactttgctcgaacctccaaattttattacatacgacagtcgagggactgtctcaaaaccttcaaaaagtcatgcttcttttgtttaagtggctcaatcccactcccaaacatcccctccctgctaaaaaaagaaaagcacacaagccattcccatcaacctgtttgtgaacttaataactttactaatggcttacaggtatacatgctttgcataatgagatttcattgtgaactattcttaagagctctatatccttcctttctactatcatttattcttcttccttttgaggatcaacacaaagttaccactttatgttacatagaaacatttaaaatctttgatgtctcacattgaataccaaaggccttgtccagtattttcccccatcaattatagttctctttctaagtgtaatactgatgacagctgttaataagatataaaatagggtatttaaacattctgaaggaaccttttagaattgcttcaggaaggtatagagcaaaaagttattgaaataattttgagaaattgttttaagttggaagtacatataaaatagcttagtgaagatgatgtaaaattgatagattgtaaagagcaaagaaagcacacatcttaatcttcttccatttttctcaaactcaaacttttttagtgcaatatggtttaagaattccaaaatattggtttcacaaggagataataagaaactaatgatgtatgtaaatagaaatatgtttccaggtcttgattatttccatttcataactccaaaatagactttcaattgttagaacagagccactattattaatctttgagtaattacgggaatgacatggaatttatgtggcatttcaaaatggcagaaaagacaaatggatcgtggaacagtaagcctgaagtaaatatcttagaacattttataatataaataaaataagtttgaatactaagaaaataagaaattacagtgaggaataataatgtcttataaggaatattaatacctaattaatattttctttctgtgaaatgttttcttgaacattgctttaaagcaatgccaaatacagtatttcagataagcctctaaatatttagctcttacagacaaaattgaataaaatatacaaattatatgacagtattaattaaaaaaatgagttgaatctacctagatacaataggttttaaacctatttttaaaaatgagttgatgtctacctagagagaatataaatgctaaacatgtaggtattatatgtgatttttccatggatattttatgatttattctacgattatcttataatttgataatcatataaaagtatattccgtgaatttttaggtaaaaaaatgctgtaaacaaacagctaatgtgttagaaatctcatcaatatttatcaggttttcaaaggatcaaattatcatccaaaattaaaagaaaataacttagttaatatcaaagaacatattgctctgtaataaatttttgaaaaatcctacaatgtaaggaaacttggcaaaacagcagtccatgtgtgaaaatctgagatttttagatgactgttatcccaagatgacttttattatctattatcccaagatgatttttagatgactgttatccaggctggtctcaaactcctcgtctcagtgatccacccacctcaccttcccgaagtgctgggattacaggcataggctactgccccaggctaagatttttaactacattgatattctctgtattattcctctgagagcttgagaatggtaaggatcagaaatgaagtaaaaaacaaggtctccaatcacatatgaaaatacaaaaattattctgaaaataactcccagttacaatgctatttcaaagcacactttttaaaacagcaaagtgcattacagtttttaattctaaataaagttaaaagtgaaaatatttagaaaatttaatgtgattttcttactttgattttgggtttataccaatgaagcaaatataagctttttgtcttattttgctgaaataatttaaaaataaagaaatacaacacaattttaaagcagtacctttattgctttttaaaaaattttccagtggattaatctgtttatattattctaaattaaattagcatagatgcatgtgtgtgtataatgtattatatagtttatttgttctagcaaaattatttctattagtgcactgccactaaaccattattacagacagaataataaaaattgagtaaatttttaactttaaagcaaaattcatgagagcaaaaacaacgtaataaactatcacaccaacgtaattctaactctcacatccacacagatatcttacctgcaatagctatttttcagtcgtgttttatcttccagctgaaaatgacagtgaattaaactgaccgtattatatgctatggtaatcacatattgtctaaaatgttattctaattgagtcattttagaatgttttcattatattttcctattacaaataataaaaacaatgaaacactgagtccttattatgtgacaggcacgcttataaaggctttatgtgtattaactcatttaatacttaaaactaactcttcccctattagataggagtctatgatgatgagaagtctcaggacatctacgtttgttttataatatagtttgtttcagaatgccatgaatttattttactttattattgttccttattttgtcagctttacagaataattcctgaatataatcaatgcaaatttttggtttcaaaaattttattctgaaataactcaaatgtccatcaacaggaggacgtaaaaacaaattgtggcctattcgtgcactagaatggaactgagcaatgaaaagccagaaattaaatgcatcaacatgaatgaatctcaacaacattgttgagaccaaaagaaattagaataaaaagagacgaaattgtaggcttccattattaaaaaagtttccaaataggaaaactaaactaaaatgaaaaaaacaaaatcagaacaactgccaattctggagatttaagggggaatggtgaaaattgactagaatgaaaatacagaaacattctggtgagaaaaaaattcttctatgacaccctagggttatgggttatctgggtgtatctgtttttcaaaactgtaaagctaacctttgtgcattagaatatgtgatattttaccttcaggaaaaacaactgtaaatagagtagttatagtagtgattgagatgtggagagtagacagcggtataggtggtagatgaatgaaaaatgttgataaaagttgagtgatgaatacatggggctttattttactatagctttattttatatacttggaatttttaatttgaaatataaaatttttaaaaagccatttcaagtgttttccctaaaggctgtaggttactgtcatcaatacttggttaagaggtacataaagtttcatagtattaacaaataaagcattagataattataggaaattcaaaaagaaaatttaaactaagataaaactagctctaagaaaggaggggcccggtgcagtggctcacacctgtaattccagcatttggggaggccaaggcgggtggattacttgaggtcaggagttcaagacaagccttaccaacatggtgaaaccccgtctctactaaaaatacaaaaattagttgggcatggtggcatatgcctgtagtcccagctactcaggaggctgaggcatgagaattgcttgaactctggaggtggaagttgcagtgagccgagattgtgccactgcaccccagcatgggagatagagcaagactctgtctcaaaacaaaaaagaaaaaaaaaaaccaaaaaacaaacaaacaaaaaacaaaaaggaataaaagaaaaaaaagaaaggtgggtggaggagagctgctttccttgatttgtaaatttctaataagcagtgattttttttttctttttttgtgaactgaagctactcctgaaatgagaaatagacaatgcttctagcttttttccagacttttagactttcacttgaacagtaatttcctgtatgtgtgagatacacagatacatagataaagccttttttttttgcaactatctcatcaaatctcgtattcacaataaagttatttccatgttgagtacatggtcttaataaaaatcgtgttatgaaagcatacagtgggttgtgtaagcagtgtgtgaatattggtttcaatattacactattgtatttcttgataatgctagagaaaatgtaatttgcaatgcatttatataagggctaaaataatttgtggcatcatttttattgcgcattcatggctcatatcagtttaaagcttaaaaagctgtatttttctccattaaaaagttgtatctcactctaacattgcatttcagatttatttcagtgcactaatcatagtaacagaaatgccacttattctaacacatttgaaaaaactgaatggactcattatttggttattatcaacttttagttctgaattcctatgggttttcatgcaatgcactctagtacattcagaaacaggagagagggttatattcaggtagaagcagtttggctaatgtgttggatattttacagctattttcttggccacgttataacattctgaaaaaaatcacagaatcatccatttaacacctcattttagactgtgctgtgttctaaccagaggtcagcaaacttttgctgtgcaggatcagagagtaatgttttaagttttgcagaccataaagtctcttgattcaactcagtcattgtaacaaaaacagtcataaacaatgaaatgaaaggacatggccatgttctatcaaatctttatttacaaaatcaacctgcaagctgcatgccaacctctgttctggactcatgcatcacaaacttcaatgtgcataaaaatctacaaagattctcattcagtaaggtctggtgaggagcccaagaatttgagttttgaactgattttctgtatgatttaagctacatgacttaaacattgtgcacctcattttctatagctgtaaaaagagctcaagagtttcttccctacctgctcaacacattttgtaaaaattgagcagactaatatatgtaaaatttaataagtagcatacagagtaagaaacaagcattatgaagacaacgtattgaggatttcttcccacttgactactttttcccagttctgtacaccagaatctcaatggtgtaagtcataatagagccataatagggtctatttcaaatacccttctttcatagtttccaagaacatgttaaagatttattagtttccaattgttgctgtaacaaactatcacaaacttaggagcttcaaacaacacaaatttttcctctcaagtgctgggggtcagaagtttaaaatgaatcttatgggattaaaactaaggtgccagcagaacagattccttctggaattttgaaggtggtacctgttccctgccttttccaacattagtggctgccctcattcttttactcagggcctcatatcacatagcctttatcccttttttttctcatataactttcttttataaggacccttggataattcagaatcatctcttcatccccatatccttgacttgaccacatctgcaaagttctttttccatgtaaagtaacatattgataggttctgggtcctaggacatggatatttttggggaccgtgattcaccctaacacacaagagtatgaacaaggtaaaaataaagtcggggggtggggtggggaattgagttttccatagaaagagaatgataatggacagaacatagaattctgaaactttcctgtcagagttgccaatgtttagggtcctagagcagagaggataaggtgtcctttaagaggaggctttgtcgaaacctgaaccaatagcagaagggtgagatatgcctaactaagttggagagtttttggtctcggtgataggcaggcctagtttgcctataaaactgaaaatgggctaatgaacattgcagcaccttttcctctaggcaaagtcctctaagcccttcagccttctgtgtttaggttgattgtgtcaaccttaataacagagagggagactctctaaaagaaaatggtatgtatttgagaatcggcattgcaatgggaatacacaggccatagtaaactatgtgcatattcaggaaggtaaaagaagacaaagcattttaaagaaaaaatgagaattacataattattttgagataattatacttggcgacaaagattaataacaagggtggcacaagtccaagtttggacaggcagttgcttggcagatgttctcaagaagcattgtgtgtgtgtgtgtgtgtgtgtgtgtgtgtgtgtgtgtaagtttgtaattacatttgcacaagattgtggtttttgcagtcttctgtgatagtttttgttatcaggcattcatatataagaaccctcacttcatggccttccccagctctatttgtcagggttttaacacaagtgactccattttgattcttacagctttcagacatttcctccttttgatcaagatctttacccacaacccacaagcattgatgatcaatttcctgtatttaagttttgattgtcccttggtgcctagatgaacctgtcctggttggtctggtctggtcccacatcagagacagtaattgatgagtaagtcagtgtcaaaactttcttatctacatttgagcaatttcaaaggaggtatggaggtagtggttctcaggctaggtctacctgggtccatggtaagttcaatatgtctgttccacaggtattgattatcatctcaaagtgctaggccaacattactctcataggggttgtacctctggaaaaaattaatgagtaacaagaacaaaaattaaaaagaaaaatacaaagaaaaattaatagtgatatgataatctcagtttacataatagtttgagctataaacctgggcttaaaggaaaccaattaaataaatcaaataatcatgggaaattaggtgacacttttttttttttaaccacgtggcctattttcttactttttttgtatatagacctcacctttccctgagggatttgtccagatacagcatgtaatgttagtaatagcaaagacatttccttgtttaaccaatagattacatagagcaattttatcatctagtatcccatgactaggctgaattcgagcagagcgtgagcaatggctgtatgagaaatattgccatactcacccactaggtagactaaagcatctcatagctcaggttcagtcaagttaccagcagaagctactgaatgtgaaatttcaattacaccattatcctgccaagtgtaaaaagtaggcgttaaaaggggaaagagtctcattatgatatggagtcttgttccaatgtcttggaaaaaagctatctacagcatgcagctatcaacttatcattctagtttgcagtttgaatgtttctggttatggcaccaggcagtttggtgaactttctgtgtgacccatacatcaggcacgaaacttacctcttagaattcatctggtttcagcttatacagcttcagtacagaccagttcccatttttagtaatattacggaagtgttaatgggaggggaatggagtttataacgagcaaaagactattcctaggcaagttattagaggagtacacatgctcactagtgaggaaaagcccctaactcagttatctccggttagggcttactaagtcccttctgggtcagaagagcccagccacaaggccaagtgcagccactgtggccatggttctctttttgctgactgtcagtatctccaaggattctatcaatgggcagcatttctaagatctctttcctggggggaacccttacctgctcatgtctggctatgtgcctattctaacataaaaaggttggactggagaaatccagaagaattcaggatctagtcagtttatagtaggtaataagaactctaaaacaatgcctagggctaaagtcttataacaggtgttttatagcttttctttagaaacaaaacatttttctctttacattgatcagacaagaatctcagatggaaaaatctttccaggcttggaagccaaaccaaggcagatttcagattttaccttcagtcttgaagtttctaggactgtcaggaagtgacaatttttattcactgacagtaaggtttggaacccttgaagctgggcattctatgctagttctcaaaaaagatattccagttaaggctttgttttataattaatgcttccgattgtatcattttctaaagagacagcaaaattttattaaacttatacaaataaacatattaccacaagaatacccacacatagtttccaaatttcagagggatcaaatagagagaaaaagtaaatgtttccacctttattcacaaaaacagactttaccaaattgctgtattaactacgatagcttaaaagaaaaagttttcttaaatttggaaaataaaacatttaagttaagaatcaatagtttcaaaaaagtcataattttttttttttttttttttgagatggagtctcactctgtcgccaggctggagtgcagtggcacaatctcggctcactgcaacctccatctccagggttctagtgattctcctgcctcagcctcccaagtagctgggattacagacgtgtgccaccatgcccagctaatttttgtatttttagtagagatgggtttcaccatgttggccaggatggtcttgatctcttgacctcgtgatccacccacctcagcctcccaaagtgctgggattacaggcatgagccactgtgcctggcctcataaaatttttatcttcatcagttaattaatctctgtaattaatttttgttcagcttgatattgtttggaagtttctcaaattggtcaggttcatcatttcagaaatttttagagttctaagaattttttatgtcatcctttgaccttaaagttactagaaacctacacttaagagtacttcttagtcttttacatgcatctgaaggaagtgcttttagagaaaaatcaaaactgtagatgacagagacagatgagccatagttaaaaatctgatggaagtttgttataatcagcaattgacaagaaaatttggttatttttgtaatatacaacataataaccagaattatgtctgatgccatattaggtttctaaaccttttatgcaattttggattatccatatcaataacatacccataaatgtaattgaaagaataactagcatcacttaccatttgacaatgtttcctacataattcaccaaattaatgtaatgatctaatatctctataggacaagagttccattttttgaggctctctcaaggcccagctgaaaaatcccaaagttagttctaggtcaaaaagacttagaattttgatactgaggaagctcatcaaagatgccaaaaggttcaaaacacttcatcaaaacaggactgcaggtaactgtgaaataatagtatttctttaaccagggtgataatcaaaataaataaagtacatgactgtaaaagcaaaataaaacaaatttaactttttcaaagttcagctttcctaagttatcaaaaaatctaataaaggcaacaaaggaaattatcttgataaaacatgaaatccttgtttcgtaggcctgttaccaaaaaagaaaaaaacaaatctactgaagagtgattgcttctccttaaagaaaactcttttaggtaaactggaaagtaaacctagtacttaaatttaatcagatgtagtaagacagtgtacaaggttatgattgtacaacataatacacaggaatgtaaacagaaaattaggaccttgagcaagggaatacatggctcttagtaacagcatgggaagtttcctggttacatgaaaaaaaaaattagacacatcaagaaatgccaagagcacagaatgaatttatgcttgaggaaaactttgcttttttaggccttcaagaaagaacatttcagcatcaggccataacagcagagttaagaccgaagaaaaaattatgagagctgatgaaaaagttgaaggaaagagttatgagcacagccaagcaaaaagatgtaccttctcaaggggagaaagaggaagaacaaaaggcaatgatgtatgacctgcaaatcacataaagttagataaagcaaaagttgaacttctgagatagaaacttgagaagcttcaagaggaaaaatctacctcaagaaatgaaataatctaaataaagacagaattttcaatctaaatccagaaaaattaaataaatctcaggaagaaatatggcacaaatagaaactgtaaaacaggaagaagctgcagtttagaagatggttgaatggttgaaattttttttaaacatatttcggaattaaaccaaaacctagcaaattttactaagagcaaacacttcaagaaaccttattgtttgaacacaaggaaccaaattgttagttttgtatcagtgtatttttaataccaaagctcagtctttagaaagacacacaaataattctcttacaattatagccaacctgatcacacacaaatttccatcataaattcatctttcacaaaccttccatcacttattcagacattccatgacatgagcagaacttcagctttgtcctacacttcctctttcttacataaccagtcatttgactttaggacaaaaatttaccacataagattctttctcataaaaaaattattatttttttgtttttaatctaccttaccaaaaatgcattttcatatgtataactttcttcatatgtctttgttctactaactggttcctctccatcatgtttctacttacttccttctaagtccatattttgatacaaacttttaataacctctgaatttagacaaaattattctttagttcagtaaagaacatatttttatttccttcttatactttctcttatcaaaaacatctttttgggtcactttctatacagtattatatatacacattagaatttttaacacttaaaaacttcttttctagtgaaaacctaggaagcaataaattttgcactgtgtcacttatcagtattatctagataagaaccattttataattttttagaaacatgcttccctgtaacataattatgtgaattaatagactcaaatatatatagtttttctataaaacttaagaagtcaataacaaatgtatgcttacatttagaaatttttgttttagcatttttttcttatttggaagtgacttagacatttaatgagtatctatcacttaatttaaaataacataactttagactttcaaacttcaattagcgattcaagatggctgactacaggcatccggtacttgcctcctccacaaagtagaaccaaaatagcaaacaggtaatcacactctgagtagatcaactaatacagaacaccggcgttcaatagagaagtgacaggaaacacctgaagtgtaagggacacgaggaacacagtgcagcttgctcagcaaggatcagctggcagcctggagcggctccccagtgtgggcaaagggtaagtgagtgaccccagtggttcacattcccaccagagactcacatcatagccatagaaaagcccctagaccctcggagtccctgagactaacataggaggctgcttggagaccacacaaaggcattgctcaagagagggagctcacactgggtttcacacaatctcagcccaaagcaggtacagccatattgaaagcccagcccccaccagaaggtaccctaactggggtcccaacagtccctgcatctccatatttctgaaacctcattgacattccctacccacagccaccaccatagctggctggctgctacctccagggctaaaatgtgagccgttggcaatgaccccgctgtcctcagcaggaagccaccacacattttcacgtgcctcaaggaagccgccaaacattttcacatgcctcaaggacaagcttacctgccccagccagggctgaaatgtgactgaagtaatactccccagtcacctgcatatgactgctgcttctgaaagtaaccccattctccccaatagcagggccgcagtgcagccactgccacccctactcaagcattctgatgtgggcctggagattaccttgagcctgcctactacagccagtgcctgttcacagcatgtaggggcctgaagtcaggctttcctagcctggctctacccctcagtacgcggccactccatctgagagcctgggaactacccagctcagtccaccattgttgacacctgagtattgctactggggcccaaggttgggcccatccagcctgccactaccaccatagcaggcacaggcccacatgcaacagccgcaggctggggactggtgcattcggcccatcacagccactgccaacaccagcacagaccacttgggactcagaggttattttacatgtacctaatttagctttaacaatcatacttggattacttatgaaaactaagatattaggctaagctagtcatcatttcaagttatttctctgataactctttttctagcttatgattatcaggtgatcacctaagtaagaatctgaagtatatgggtattttgccaataactcataagatatagttgtttttattaaaccaatactatgaaattggtcttatttatcgaagtgttatacaaacaaaaatcatcctgtttttaggcttggtttatagtttcatgattttaaaacatttatcagggacatacataaaagtgtctaaggtccgggcgtggtggctcaagcctgaaatcccagcacttcgggaggccaaggtgagtggatagcctgaggtcaggggtttgaggccagcctgaccaacatggtaaaaccccgtctctacttaaaaaatacaaaaactagctggtcatggtggtgggcgcctgtaatcccagctactctggagactgaggcaggagaatcgcttgaacttgggggtgaaggttgcagtgcaccgagatggtgccattgcatatcagcctggacgacagaacaagattccgtctcaaaaaaagaaaaaaaaagtgtctaaacagtaaactcaggcaaaaatgtacagtgacaattctgaagatatttcaatttttattttgacaaattttaaaacagcttactgatcaaagatgcttcagtcatggaaattaaaaggcatttaggctaattgctatattttttaatatgagcactcatttatctaaaccaacctgtataggatcccttaaggagttttgagctgactatgccagattttaccatgtagataaaacatacaagaggcataaacatatatataaaaatttaaataaagatcctatagatttccttttagaattttaatcatgagacagtaaaacataataatataaactcttcagtttataacagacaattagagctgaattatatttctgataatacaggaactgtttacgtggctaaaattttgccctgataggtaatgtaatgaaggttgtggaccataattttgagtaaagtaatttggtttaaaacaattattttatcttttttcctctgttttgagtttttaatgagtttcagtgttaaatttctaaatatttacactttagttaggactggctatttttcttttgttataagaaaaacaaaacatccaagcggccttggatttttaataaccaatctttttgtttgttgtttgccagtctggttgtttgactagtgtcaatgcagggcaggatgcttttaagaaaaatatttgcaggcttttttccccctctcctatgtggcagggaaagtaatctttatgcccaacagtaataccttatgttatggctctgagctcaagattttggcctgtttgatttgaaggcctaacctttataaacttttatctagttatttccttttagaattaatcctttgattaattgtttcatcatgctaagcaattgttagtctagcttaatttaagttcacatttccaaaggtgtctagattgttggttgctaaggagctgttgtaatttgtaaagtcattaatttgaaagccctttaagactcttatctcttattttggtttgaaatgccctaagaaaaacttctaagtggcttttgaaattagcagcattacattatcttaatacaaataaaaacgtcaacagattcagagtaagtagaaaaaaatatacaggcagaaaacttagacagctctacatgttaactgtatagttggttgcactttctaattcagttctaagagaaaaacaacttggggagtgcaaacgaaccccatgatggcattgattttaaaacatgcatgaggaaactccacattggtggctagagtcccaaacagcttggcatgccttaaagtttgagaatcctatttcattttttaatttatctctcaagatcatgcccaccatttaaaatgttgggcgtttattcctttcagaacatgatcagaaacaagcaagataaaaaacagccaaatcatttacagatgcacgcatccaaaccaaaataaaatcagagtgctcacaaaaatgttaacccaggcatacagatcgaacaaaatattaaacatgtgtggagacccaaaagtaaatttgacagaagagacatgcctcacagagagaatgtagattctgtaggatccaaaatactcaaaccacaagaacatttgtctttagtctcaaataaagtaaaaaaagaacttgccaaagtaagagtcctagaatccaagaggagatacacagtgggctcagttgataccacactccattccaggggttgccaatttgtctgaggggatctcattttggtcctgcctctggcaccatgatcccaacctaaataacaaagaggaagacattctaagagaaaattatatttattcaaggataggcactgcaatgggaatacacacggcaaagtaaactatgtgtgtgttcaggaaagtaagggaacacagaggattttaaaggaaaacaatgagaattacatcattgttttgaggtaattattcttggttacaaggatcaatagcaaggtgggtgccagtcaggttggacaggcagttgttgggtagatctcattacagaatttttttttttttttttttttagcataagattgtgatggcctttgtccaaggttgtggtttccaggcttttgtaatattgatgtaacatagcattcaaatatggcttataaatacggaatcctttataatttaagtttaatataattactttattccaggattcaggccaagaatcatttcttaattttccaggtaatctgtaaaaagataattaaaagtgcctatatttttgttcatactggtctcatctataaaattgatcactgaaaaaaattgtaagtgctaagtatacaaaaaaattatatatagaagcaagatttatgatatatttgtttctaattgtaaaatattttctttctactgtgaggtttcaaagtaattaaaacaaacttaacagaaaatatttgtaaagttaacatataatattaacaatctgttttttcagcccatgaactgacaatataggtgtaaattgtgccatttgttgttagaaactgttaggttttaaaataaatttaatcacatgatttttaacatgaaaattaccgcagttttatagaacagaaattgaaaatatgaaatgaatgcatttggttctttttgtctaaaacaaatcattctcaaatagaaatataatataattaaatttttaaaaatggagggaattgaactccataaagagatatttcattacacattgggcatccttgtagcctatgtgagtttttggccactatccctgtatttctatgcaccctctatctactcctttcatgagtatacctcatgtaatattttaagttgaaacaacattgcttattttatctggagatcttgaagatgagtaaacttttttatttgttatatttagccaatcctaaaagtgttctattacactagaaaaacaaacatatttttacaacctttgggcttttgtcaaagaagatttaattttaaagaaaatatatgtaagtactggggcatcatttaaaacaaacaagaaatctcttcctttgtgtaaataattataagtaagtactggggcatcatttaaaacaaatacgaaatctcttcctttttgtaaataattataactagtaaaagattaattcaactgactgaaagaaaatatgaggatcatatttaaaatgaaaaaacagtatttacttatggttcattttgtttaaaacactttcatcttccatgtttcaccatgcctttaaaatatatatatatatatatatatacacacacacacacgcatatatattttatatatattacatatgtatacatgtatatatatacatatatattttatatatgtgtgcatatatatacacacacacacatatgtgtttgtgtgtgtatgcttttattcatgttggaattcatgctgtctgcttctttcctgtgctcttttgtcagtgttttcctgactctcagaatgcaaaatctgcttcatttttaccacagaatctcagatttcatctaggtagcatgtaatttatatttagctgtagattctttgggtgtgttttcttacagagtagatgataaattccttgggagtagagattgtttgagtttttgatgcttctccagggcactgacttactacactgttcattgcacacactagatgcatagatttatgtttactttaacactggtcaaccatgtaaaattgacatcagatattatgactgatggataagtactgttcttctcatggcagagaatcaatgagacagctctcctgttttgtagagcaaagctcttataaaatagtatatattattcttcagagtatttattgagcacttaaaattttttgtttgaaatggatagaaaaaagaaaacaaaagatgattttaagagaataactcaaaaatcttggaagagatattttattttgatcctaatgcatacaagattaactcagcccatctggttatacaaaaacacaaacagtttcttcattaagtttgaaattttgagctatccaggatttgctttatctctaacagtctgtgcagtgccaaatgttgatatctcatttccttgactgtgattaaattttctttatatcagtggtgtagtatttgaaaacacccaatttaataatatctttgtcatatatttttattttttgaacacatgaattttgtatttccaatgtgatttagatgacattttgtttctatcaccaaaaaatcatcttttccaacagcagttcaactctgagattggaaatactttaagcctcaacattgtcaattttggctctttgtcattttcctcaatagggttactttattaatttcagggaccttaaatattgtggtatgtatgagtgtgcacgtgtgcatgtacctgtgcctgcatgtgtgtttttctattctcccatgtccattacttaaatatatgttattacttcatgttgaatttgtcttataaacaaagccaaaaaactctatttgtgtttttactagatataagccatattctttagatgaatcatattggaacctttcagtgtttttatgaatgcagtgtttaaaacagctaaacatctatctaaaaatgttcctctttgagatttgaagaaaaaaatcttactcttatgaatctatctctcataatattgccatctgatcctttaagtatcttttttcccctaatcaaatttcaaaagtcatgttgtcacctctaaaatatagaaactgggacattttctgccttcatttataaatatttatatgtcagtgtctacttagtgtttgctttaattcatctaattttgtgtgtgcatgatagaaactacttacaggattttccactgaaaattacaaatgaatgacttaactgagaaatgcactttcaagtgactaatgaaccaagcaaacaaatagcagaaagaacatcaatgtgcttattctcaaatcttcagcaattctgggctgtccattagatcgttagttaagcacagcaacacatacaaatataaattagcctgaactccagtttttctcccttaagtatgtggctaacttgctagttgggtaagataatgaggtcatgatccaggaactatgaatagagaatccatagaactggttctgcgtacattagtataaaccaatctacatagttgcacatttcaagttgttccatctatgtagaaattagattattgggatttggaagtaataaatagattattcattgttgattcatttcaacatatttattgagcatctaaactgagtgaggaaaattggtttaaagcatagctggctctcaaatattctattgtgtagtgaaaaacaaaaagacaggtaaacaaatactatgaaacactcttgggtttgtgttgaaactatggtggatatcaatgaatgcaaaagcatctcctgtgctgcagcctgatttgtatggggttgagataagcagtggaaagtgtacagcacgggtgaccaactgaactgaggtttggataaccagggcttctttagtcagtatcatggatagagaaccaggattctagtacatgcacttactatgttcaaagctgcagaagcatggaaaggcatggcatataataaaagctataaaatggccatacacaggtgactgctgagaagtagagagcaatgtatttggacaaagtctcaaagatcacatgataaattatctgattctctactagcagatgcagatttttcttgaagaaaatgtagaagaaaatgagcaatgttaaagaaggtagtcacatattgagtgttttgtttgtatgaaaaaaattctgacaagtcctcagaaaattagttgactgaagaatgagatcacattaggaaactttctatggtaagcttgtttaagcaattatgagggtatggattaagatagtaacagtggccgggcgcaatggctcacacctgtaatcccagcactttgggaggccgaggcgggcagatcacgaggtcaggaggtcgagaccatcctggctaactcggtgaaaccccatctctactaaaacaatacaaaaaattagctgggcatggtggcgggcgcctgtagtcccagctactcgggaggctgaggcaggagaatggcatgaacctgggaggcggagtttgcagtgagccgagatcactccactgcactccagcctgggcaacagagcgagactcctctaaaaaaaaaaaaggtagtaacagtggacatgagaaaatgaactggattaggaaaacatggtttattcatcttaatgacctactggataaagatataagaaaaataggaatgtagaatggtttcaacctttatattaaacaactgggtagaagagggtattttataacatgagaaacatgattggaagggagactggagacaatgataaattaaattttggacatgctgcagatgaaatatatgacataattaagaaaagttgaaatctggagtatggagtcagagtgattagtcagatattcatcaactgtattagtcaagagagactaacggttgtaacaaatagctaccatatttgagtcatgtaacacagtaaagtttatttcctgctgatacaatagcagagcagagatggtcctacccaaagcattaaataaacaaagatttcttccatcatgtggcttgtccctcctctgagtcttggtctttggcgtgtaaatgaagaaaaatgtcacaaatggcatgttggtagatcacattcactcacattccatgttcagaatccagtgccccagccgcacctaactacaaagagggctggacaatgtagtctaggtgcatgcctacttttttactaaacagtgagatcatttatgatgagacctcatttgactctttcaaatttaccatccattgcttcttagcagtcatctaagtgccagcttttctaaagagaaaaacgtggatattggggagcttttataacaataattataacttaaatattataagctatacttataattttgatatattagtttttatttttaaacaactcaattttcagattagtgaaattttccagaaaattatgtattcttgaaaattaaataaattaattctgcagaacactgaagttctttaaaatccatggaatccccagccctggatgctgtactggattcatcttcaagacactgatgacacatccaggacccataaaaggaactctgtacttaggaaaaagagagagagagagagagagaaagagagagagttgccacataacctttgctcttaagcttaaataaaagcaataacaaattctcctctactaattgagaattagtagaattctcaattgagaattgagaagcaaacttctaccagttcatagttagcgtccttcagggcttcaattggctattgcaataattttaccatttaacatacgttaatgctttccgacatagattttgcaaatatcaaggtattctctggcagtgaggttacatacataagatttttcaaatcactgagaaaatttaaatcacagtttcattttgaggggagatacattacaaaatagtaaaaatacaataataatcaatatatgagaaaaatttaatgatatttgttaatgatatgcaaacttcttgatcaagcaccctaaatatcacattcctctcacactgagtacatgcatttggaagttgaaacactagttttaattgcataagttaaaagtcattaattctgtttctctttaaaaatttttaaaagacagagataccaatttctattttaaaaataatgaagtaacctcaaatgctttgaggacctatcaaagtccacttcttgtttttagttaggaaataatttcagtttctaatgcttagctgtgcgttctatagccagactcatacaaaagtttcaataaaatgatatttcattgaacactgtgaatgagagataaatttcatagtttagcttcatacttttataattcaaacaagcctcacattattgaagtcagtagactctatattacctttaccttgaaaatctgaaactatttgatatttcagactggatatgggactttgtaaaattggattaaatctagatcacattgaaaaatgccttctatcaaaaaaaagaaaaaccttaagtgatttatcttttttcatcttttattttttatgtgtaacttatttattgattataaaactctgttcaattttttaaaaacatacctgggcattagtctcctcatatgtaaaagaatgtatagtctggcctatttagtctcaatgatcccctttaatcccacagattcataatttaatatttatttttctccatgaccttgaaagcgatctaaagatcagaaaatgtttaaaatgtgtttgtttccccacgttgcagcttgatggcatcagattttgtggtgatatgcctatttaaattttgaaaatgttaatttagtttattttatatattaaattattttataattgagaaaaattatgatcatatagaatacttgcatataattatgcacagctccatatacatagattgtacaaggtaactgactatagaatgagtaagatcattttcatgctagttttagtcattttcactcaataaaatatttactaaaaaataccaaccatgcaaagaaagagtcaagctacgatttttattatgtaaaacaaagaccccatagcaattaaaagtaaataattagtccccgaaaaacaaagcctgcttattcttacctttcctattagccatggaattacctttattttctttctatattaactaactcccatatacccctttttaatggacacaaaattttattatgaatgtgttaacagaagtctttatatgatccatttagatttctcattcatagagagcatttagtcttagagactagaataaatgaatttgggagtaataattcttatatgtcattattgactgttttttgttattgatacattaggaacaattaatacttatataaatttaatacacctatgattgcttttgtattttcttctttttaactttgtaaaaggaggatactgactctgagagaaggaaagtagttttggtattttcaattatattttgaagctatatatacactttacactctacataaatgcaggggaaatgctatttaagaatattatcaaaaacattgtatataaatttaatctcacaaaggtgtacaagattggaatatggtaatagtttcttcttcagttaacagataaattgactgaaagtttatttgcagacattttgcctgagccaaacaaatgacgtctatttagagaagaaatcagaagagtaaaatccatgacctgaatggagagaagccacagaatgaaagggacatagtgaacatgttagtaaaagatttgccaacagactttagaaaacaaaacaagaaaaaaagccaaaaaactacaggcagacagatgaagggtaggtaagaaaccacaatggattcaatgtgttctgtgatatttgagctctttccctgaattttctccctagttggatgagaatctactcattcaaattgattacaactttgagcaactgcaagaacagagaggcaggtgcaagttatgaaagaatctggtctttgaaatcactatgccatagaataggaaatccagtgattttacaaaggcttgaattgtctttctttaggctaccaaatagtaagccagctgcatttggtacagagtagtgattgccgaaagctttggcaactgagaaaacaccaacctacagtgatttggtggtgttgccatgagcagatgagctgctgcggagtcctgataaagttgattacatattttgcaatataatattgatgaaataggttctaaaagcatttgaaaatatcagctttagcagcacaaaccattctaaaacctcccaaatgaacggaattatgattggttgaaaaaacttataacttgttcagctcagttctctttatattttatttgtaaaatgaagctaaatgatagactatacagattattatgaattacgcagacccacaggaatattcaaatcctgtctctcaatgattttatcatacttgatattttaggtgttacatgttattatattactcctttttgcatttttgtcctttgcatttcgttttatcgaggttcattagtctattgctttccttcattttcctttttttttgccaactatctcagagtcaaatttgatgtctaattatattaatttacttggactgcctatatatatatatatatatatatatatatatatatattttttttttttttttttttttttttttttttttgagacgcaatctcgctctgtcgctcaggctagagtgcagtggcgcgatctcggctcactgccagctccacctcccgggttcacgccattctcctgcctcagcctcccgagtagctgcgactacaggtgcctgccaccacgcccggctaattttttgtatttttagtagagatggggtttcaccctgttagccaggatggtttcgatctcctgacctcatgatctgcccgcctcggcctcccaaagtgctgggattacaggctaaataattgttatctttattcctggctaccctgtgttattttatacttaatttctaagttgtctctcatttttttgtaataagaaaagtttataaattatttcttcctctactaaagtgattgtatgaaattctcagaaccaatatttcctctaacatatacttttaaaagtaaatctatcttgtatataaccgaagagatagatcaatcgatcagcaatgatttggaagggaaaggtggcagacaaaaggaacagaaaaattaactgttacttagtgggaactagcttgatgtgttccaggaattttataaggccactgtgctagaccttattgagcaagtggagaaaagtatataagtttggaaaatcatactggacctataggatcttataggtcatggtaatttgagttttattcttagtttggtgattgctcactgtttatgcccttaaaaatgttaaagtgcttcctttaaagaggaaaagtacattgaatatactttttaaaaattgattgatcaaaaataaaatttcagacaaatgcataggtttttaaatattttagaataatttgacaaacacctagatgtttacacaattctagaattttaacagaactgttgaaaaacccaaggcttaagtcagttagggagagaattatatctcacagccaagagtgttaaatactgagccctaaactggggtattaatgtaaccttagttcctgatagatgtaattaatataatcccaattccaggatgaaatcctttatattctagaatatagttgttcaggtgtgaaattgatgaatgtttttgctgagagttgggccgtctgtagtactttcttccaacatacttgtgccttccaggcaaatttgaaaattttagtaagtatatttcttcaaaggattgaattctgcccttttagaaatagatcatgtccccctcacgggaagcaactaccctgttctttacacaaatatattttcacttatttttttaaaaacatttccaagacctaatttttaaagccactttgttgtcattctgattactcagaaatattgcatttctttactgtgttaataccaaaaaaactttcctatcaagttttcttaaaatgtgtatattgtactccatatatattaggtgttcaacaagtacttattaacattgtttaaatagtctttttttttttattacatgcactttccaaattgtgaactctgaaaacagaccattagttctattgtatgtactctgagggtgtttagcacaaatttctgctctcataatcccaacaaacctcataccaatttgttgtatcacaactgatatcagaaaattcgttacatttctttatgcccaaatatttccatacttaaaattacctagcctttttgcagctacatgttgcagaaaaaggtgtcatgcacaaggtcatgttttacctttaggctacattcagcaagaaaatgaatttataaaatatagtactcaggagaacagatatatggtattttgtaagacatccagaaatttagtatactattaaattcctctcacagataatatcagaaattctaatagtctacaaaagtcttgtttttatttaacaaacatctatatagcatttactttgtgccagtcattgttctaagggcttaataaatatcagcgcatttaatcctcatataccttctgacataggtatcactattttctccattttccacacaagaacattgaactgaagagatgaaattttctcaaggtcacaactagtaaatatacagtataggatttaaggacaggaacgctgtctccagaaatgttctcaactgttatgttagtctcactaactctaaatctgcatcaagaaaagcctgccttcaaattttgtatgtattcactagattgaatatttaatacataagaagaagaaattgaatcgagagcaaagaccataagaggttaaagcctgaactgacaggagtttacttggcaagggaaatttgtttgttttctatcaagtatcattggcactcaggattaaaaggaggaaagggctaatagtaaaaagtaatgtatgaatattctatgtcattaccaaaaatataaaagaaacctagcaacctcctgttaatggtatgaaaggataaaggtgtagcaagtccttctggcttctgtgtcaattatgtaccatttattacaaacctattcataattttaatttgattaatctttgccctttatgtaaattaaattagctttagggaaccaaagaaaaataattttatgtagtgttactttgatgccttacagctgagacaaggtatggatggaaatcctagagagagagcagaaaagctttttcagtgtgctggatagtaagtgtttaagtgtcagcaaaaacacacatcctgttcttagatttttccatcaattcgaagcaagcactctattagttgctgggaaacagaaataaattaaacacaacctgtttctttcaagaatctctcaatctgttgaggaaggcaggcaaaatacagaaataacatttacaatacaatgtgatatacattctgtgcccaatccgtcatttgtcagatggtacgagtacaaattcagacaaaagtttagtttgattcatattttattttaacaacattgattattttaagcatataatgagtaattagtttaagtcaactcaaggtaaaaataagcaacttgctgttgaactaagtaactaagaatactccttattttaatattttaaactcgtcaattaaaagaaaattgcttagctaaaaaaaaattctgccagtataaaaggacaacaaaagaggatggcagaattgaagttctagagctaatcaggtgtcagttgaaattgaagaaaaaaattaaaaatgaaaaagatgacaaagccaagtgaagccaaaatgtgtgactagagacattgggagttcccagcaaagaagtactaacttgctatttaacacttctatctgatagctgataataagctatgactgataggactaatgacaagaacacacacaaacacacacacacacacacacacacacacaccccccacactcattcctgaaataaagataggataaacaaagcaaaactgagaaaaataacatgtcatagatttgctgaaagaatcagtgtacacacacaaaaatttgtttttagttctagtggcacacttcctagatttattcttcagaaaaaactagaaagatggattttcttatggtctctggtacaccgttattttgtttatattctaaattatagaaataaatattgtaatatgaaataatttatctacatggcttataaaaagcatggtttattttaaaaaatatatagataccaaatgcaaagccacttacatgactagaaacaactgaagcacataacatctttgagtacacgtcatgctgttataatttgaagttttgtgcagtccttaaacattcagactttctgatcttgcaaaggtctacatgcatatcatagtatatgaagaatttaataaacataaaagtcactgcttcctccaccatattgcacttgattgcaatcagcatgttacagccacagtctaattataaaacgtcaaatgtttcatcagcttttctagcatagctctgtgctgcatctgtggtcactggcccattgaacataaattttaactccttttatgttcaattggaatctgaattacacagttgatgctaaactataccagaattaaaactcccttgaagataacttgtctgatgaactattttcaggaacgtgattttccaaacatttcttgcattactcataccaatgagtaatacttttgaaaaagtaattctgcctgtcttagaatttctagaattctagaaattctaaggcattagagaacaaaataaaggttacaatgagttcatattctttattactctcaaaaataattatttgaatagacaagaaatggttaaccagggggagtggatttttgtatacattaacagaaaatacattgaatactatggagagttttctttttctcctgttgccctattctacatttttagagacaactgtttttataaattggttatgaacatatccaattcagatattctcatatttaatgtatgtatgtatggatagatagatagatagacagatagatagataatgtcaattcatttaacaagcatttactggctgcctattgcatgttggatactggagaaatagcaagaaaatcaatcaagtccctgtatttagggtgctttatgagggtgtccaaatctacttaggtggttggttagtgactgttgttactatgtggctggtatatttgcttttctttctttttcttttatttttcctaagtaatttcaacttaagtttatctcttataagctatatgggttttatgtttatataggaaatctatcttttgatttgtctattacttttaaataaaattctattttaacttttattatgtttaaacatttgaatttttaaattatattttaaactttttatttgatttctttgtctttgattcatcttcattattttccctagtagatttccttccttgtttcttttttgccatctgtgtgtttggtaggtttgaggatttttgttttgttttgttttttgttttaccttttttgcaccatactaactttgaagttgaatttctatttttattgcaatgcttactcttgtatttttagaatatgtatctaaaacatctaaagtaataaatattgttatctgccttccccaaatttaaaatttacagccacattgactatcgtaatttactgcctgccccccattcatgaagtcttatcttgtgttttagttccttttttgtttctggttaccatgagtcatcttatttttatagtcaatacttacttagatagaacgttttcctcacagtagttcatatcttcaagtggagcatcatttttgttatcttatcttctttttttcccttggggcttccataggtctaaggttgggaatttatccctatagtagtttataatttgccctttctggaggacctggattttatctgttataaataaatttgtttgttaattttctcaagagtcctatattatggcaataaccagaacaactctgacctgcaactctgcactattagtttagtactatctctctatacacattgttccttatgactctgggatggctgttatttctccatgacttcaggggaatacaagccagtagataaagggctccccttccaattatcaggagctccactactctcacagtgattaggagaagcgtgttgttgttgaatattacttgcattatcaggtttctgaagtaaattggtggctggaagtattctgtcttaaagtttgatgtaaatagaaataaaataattaaataatggcatctggttttagttatccctataagtagaattgtaccgaatttaccagctgataatttactaaatccaggttccagtttcatttctactactatgtaactctgaaaacttgattgagttactcaatgtttctgagcaccatttctaggaaataaaaattgtatccaaaaaatcaggaaaaaatggagaaattttccccagtctgatatagttacatgataaaatcatattgtcacagagttttatatgagagggagctagaagtcatcttatgatagtctttcatttactaggtgaatattgtgaagttctatgaagctgaaggatctgctcaaatgttagtgaaaaagtgaggactatcattttatcttttctaaatcttagtatggtagtctttcctctgtactgttgtttcccatcttaaaagcaattcatcataatgtgtacaaaattataatgtcaaaccttcattgagcattatttgtccctgcagagctaaccccttgttttgcaaatgcatacatgcttataggtacctactatgcaaattacatgcagtaaaattccaattccctgtaagaattaagtacacaattttcattttgtgttaaatgaaactctagtattctatatggcatttctttagtggatttaagtcttatggaaatacaacatttttttttgagacaggatctttctctgtcacccaggctggagtacactggtgtgatcatggctcactgcagtctcaacctcccagccttaggtgatcctcccacctcagcctcctgaatagctgggaccacagctgggagccaccacacccagttaatttattattattattatcattattattatttttgagatggagtcttgctcagtcacccatgctggagtgcagtggcgagatctctgctcactgcaagctccacctcctgggttcacgccattctcctgcctcagcctcccaggtagctgggactacaggcgcccgccactacgcccagctaatttttttgtatttttagtagagatgtggtttcaccgtgttagccagaagggtctcgatctcctgacctcgtgatccgcccgccttggcctcccaaagtgctgggattataggcgtgtattattatttttttagagaccacgttgtccaggctggtctcaaactcctggactcaagcaatccattcacctcggcctcccaaaattctggggttacaagcatatatatggcatgagtatttctggatttagcttctctatcttctcatatctcagtctcaaccattctttaaaaggttatctgttttactagtatccatctaaaatcacaaagaaaaataaaaacatttttattactgtcttttctgctaaaacattttacttctcagatcttaataattaactatattcacgtggctacaggtaatcatactataggtcaggaaaactctatctcttttcatttttagggtcttgacttggcctaaaacttaaattggcatatgatagtcaattaacagaagaaaaacacacaaaattaatagaagttttatgtgacatagaagtccccataatgacatgaacacccattgaataaataaaatacaaatgttttatattaggttgaacaaagagaggcaattttggacaaggaactaaattatgtggggaggctaaaggaaaataagaatcattttaaacaaggtctctttgtacacaatgctcttggctatgactccaggtcaaagaatatttctatccctaaaacaagaagaacatctttctcataggagtttttaatctcctgttttcaggaagaaaaaggaagaatagaattcccttattacatctgctgtttatcaagtgtctagctcaaaataatccttactccaaaatggcatattttagagggcacattctgccgcccttcagtagtatcctttcacctactccaggtcaatcaattcttttgcgttctttatgacaataaggatttgactttttcaacataaatatttaaatacgtgtcagttttggaagtgtgaactatagaaaggcaaaagaaaagaaatataaaaggcaaaaacaaaaaaatcacctgtaaactttatgtccaggatcactacattcactctggttgcctctgtattaattttttattagtacaaaggctatacatgtctgtgaatttgcatatgggctttacacatctactagttttctgcataattatttgttaaatggcagcatggtaaatgtattattcagaagctgctcttttattttaataatagcctgagactgtttcccacttctgcattatgacagtatctcctattaaaatctataatgatcggtatggtttattatgctttgtctattgtctgtctcacctgctaaaatgtaagttctgtcagggcagggacccagtgcagagtcactgctggcaaactgtgggctctcaataaatatttgtttaattaaataacatgactgacatattaagataatttgggattcaaccaagttgtgtgaagtaaaaggggatctatgttattaatcaataagcacatattagctacaatcccccacaagaaaaactgtagttttgctgatatagaattttgttaagacatttaaatatattaatagaaaaattaagtatgtatttttaggcaccgggattgttgaagtagactgtcaaaacacagttacagataacagttcataatagaggacatgtgttttcatattgtcacttgctttattgaaaataaatttcattaagttcccatgtcctgtatttccagttttgatcattaatatatatttgttactgtcaactttattaagatgttagcctacctttctgaatataaagcttagctataatcccatgtagttttcttgcattttaatgtatttgcttcattatgcaaattttggtttctaaacatgaatatttttgcaagcaaaattccagcataaaggaacaataccccattatgcaaaatgttgaggattctcattatcgcttaaggtacagaataaaatgtcaatatgctaaacaaatgaccatgggtttggccatgaaatttgttaaaggcaatttgttcaattgacttcttatttatgagttcatcctcgatgtgtgcgggtgcacataaattctgaaagcatatgtgaagtacataacgtgtgttacattttttagaaaatcagttagcctatgaggaatttttgttttcatctttccctgagaggtgccaattctatcattcagtgtctttaaacattttgtggtttctagaaaagttatactacacaaaccctaagcaataatttatgacgaaaagaaacattcccagcttgctggaaaaatagaatagacagtaaaaaaataaaagtatgcctatcaacaaagcatataagcattgcaggggagatctctaagaaataatactgatcccttgggtgatgccagagagtaactctaagagctgttttttgcagagcagccagaaaataaccatgaaaacaatcctcgaatacctgaatcagcagcaattttactccatgcttctgcaaataacagagacttttaatagcattgtgaataaacttctccatctactggctgaaggtcaaattttgatctttattacttataagaaacgtatttatttgtatgtctgtaggcatacttttttcatgatgaatgtatgatcaactaaaggaataacttactctctttaaatcataacatggtatgactcaaagaatcacaaaaaattttgaaaacagtattattacattacagtataaattaagccaacaatttatattttttgaaagccattaattttattattatcatgattaagtacaattctgagtatttcttaaaatataatatatttcatttggctattgagaaatttttaaatttgctgatatgtagaaagataatctctacttgattgttttcatacgcagttgtggtattacacactagagatccattaagtctttgctccatctgttttcaaaacatcactcaatttgacagactcttaaactatgacttagaaatcagattaggaaattaatagcaaccaaaaacgtattgttagccagaatttagcagcctcaatttagtaaggaaagttatctggccatccaaaaatggtactgaataaaagagaacataaggcactgatcctcccagcaaaatcttggatcctaagaattttacaagccttataacctagtatgtcaactatttatatgtttcttttacaaatttcctatgcatgttatatctcacctgccttaaacaacacatccttgcccttctcaccaatcctaagtgtctgaaactatgaattatcaatcatttgaagaccttagctgccagctcgaagtgctcttacatttcacaccagtattagctaatagaaatgtgagcataatgcttattctgacttatcttgattatgctatccaatcaagatgtatttctgattctttcttataatttagaattactttacatagtaactgtctagatggacataaaacagccctgcaggaggttgttatagtagatgttttctatataaattttttgcttctgtggccacagtatgattgctaatttacacagtgaggtctccatagctaaggcttgtctatcaatagtcaacagctcatgtatcaagtttacccttcaccccagctcccacatatgctgtaaagcttatttgttagatagcagaaagcatcagtttatattattctgcatttttaaactgcatcagattcaaatagaaactgtttattgtaagaagttcataatttcaaacataagaaaaatacatacacacatatacatataatatccattttcagtatatctatataacagaccagttcttttctccttaaatattattttctaattcatgttcatgtaatacacctacacactggactcctcagtctgggtctggttaaaaataagttcaatgagagtgttacattgtatgcgctgctttgacctgtaggacatattgaagccatgacctatgggacatatcttgcagccatgacctatgggacatatcttctctctctctctctaggtcccttttctcctctggtttcctgaggctcctagaggtgtgtcattgcactcacaatccactccagtatgccatttcaagctgctcttttacactgctcctgcttatctctgggcctctgttttgtgtcatcttaaagctgctgccaccgccgagccctggttttcgcccaagtcaccgggggatgcttccaatcaccatttctaattataattttactgctggagttttattccagaaatctgagatcttcctcttaaaactgctcatgaaatcacctctgcatcattccacaggatgctgcttgccacagatcaccagcaaacacttgttgctcacttcattatctgacagaataccactgtccatacccttctcatggaccacaaaatatcacaccattgagatttaaaacacacacaattcctcttttccttaacatacacatactgtgagaatggttggggcagaacaaagcaagtaactgccacaaactgcacagagctatttgttgaataaggctctcagaacctggtcctgtgactagctaatttcttatgccagagtcttttctccctaggaattttcatacagaaatcctgaagaactcacccccatacctttactgggcccaccaccaatacaagcccactaagcatctcctcatttctgtcaactccaaatagtcagctctcttggaatctttctttaaggtttttcctcagtccccatataattcagtggaaactgatttttgaagagacatagtgccagccttgcatactcaatgtctgctataaatataattattttataagtttataattattgtagttatgtgtggttaacatgtagtttctaagaggaacatgtagtttctaagagatgggtttttcaaactgaataaaccagaggatgacctataaatattaccactgtgggatgaaaagattttagaaacaaattctaataaatgctaagagagaagagaaatgagttacatgagtagaatggtagtgaaggggctactttagatttggggcagggacagaaaaatctttttgagaaagtgttcttttagccaagtcccctttagtcagtaaagagtgcagcaatgatgttgcatagaaaggaaatagtatgtgaatatttgtggatgtaaaacaacccttggtggattcaaggaattaaaataatagataagtggctaaaataaattgagtaacaggtcacaatggaacaggatgaagttggtccctgggcagtagggagaagaggatcagtggaggtatacgacataataaaagatacattgtaaagggaagaaaatagagatatatttttaagcatactcacctaataattttaaaatattaataatgtcttatagtacaatgtaaaaacatgttgtattttaactgtggaagagagagttaagaaaagaagttgcagttgtgtatacttaagctatgttataaaataaataaagttctgattccataaatgcattaggtccttctcaatctactatttggcatatgacattaaaatatttgtttactggacccattatttaactttggaaactacctaaagaacacatccagtgatattagagacaattctttcacatgagcatgaattttaggtgactatgccaaaaagagtttgacatctggttaccattctatctatatagatgacatagattgataatgcaaaataataaaaaagtaagatcttagaaggaaatggctaagagaaataaagtcatgaaaaagaaaatatatattctaagcttgtttcaaatagctccaactcatcagtaaagaaaagcaaaataaaaccacgagataaagtttgttttaaaaaacaagttttaaaaagatttttttccgtgatggcaggaatagaggaatactcgtatcctgatgaattgtaatttgctaaaccatttttagacagctagctcacaatatatggcaagaaccataaaatatattttccaacattatttatgcaagataaaaacaaaatgaacgcagagatttacacatgaagactttcagtattgtaggtcccttaggattagctatcaacgtcaggaggagtgttttggacatttataaacagtttcagaagaaaggaaaagtggagcagatagggacttgaaacaattcaagagttgttgaaagaagattttgaaaaatccagggcagtgtttgtgaaacgtgaacatgcctaggaatcaccttgggatcttgttaaaaggtggattctgattcaataggtctgggcagagtctgagagtctctaacaagctcccacgtgatgctgctgctgttctccctacacttgggtagcacacttcatgggggacggctgtgacactacctcttatgcctacatgccttttccatatatatatattttatacatttatatctgtatatataaaaatatatatctataatctataatataaatttatatctatctatctatctatctatctatctatctatctatctatctatctatgtttttaaactgcgtctctctctgtcatccaggctggagtgcagtggtgaaatctcagcttactgcaacccccacctcccgggttcaagcgattctcctgcctcagcctcctgagtagctgggatcacagttgggcaccaccagccctggctaaatttttgtatttttagtagagacggggtttcaccctgttggtcaggctggtctcaaactcctgacctcaaatgatccacccacctcagcctcccaaagtgctgggattagaggtatgagccacactgcactcggaccatttcctatattttttaattgaagatcataactgaagtgttatgtttgtcagacaggggaatatgagtcaaagacgttgtttagctttaaaataataaaaccattgccatggagtttgtaaatgtagactgagctttctccaggtgttgtctgtggtgattgcatagctgtcatgcccacactcacatgtgagcttctccctggagacaactgcattcatgaatgagaagccatttgccttactgatgtttcatcatttgagtttactttcatttatgtaagaatgagtaacgaagaaaagatagctcagaagtttcagaaatgcaattttttctttcttttttctaagacagggttgagctctgacgctgaggctggagtacagtagtgagatgtcagctcactgcaacctctgcctcttgggctggagtgctcctcccagctcagcctcccaagtagctgggattacaggcacccaccacgacgacaagctagctttagtatttttttgtagaggcggggttttgccatgctgcccagtttggtctcgaactcttggcctcatgcagtctgcccgcatcagcctcccaaagtgctgggattacaggcgtgagccaccgtgccagaccggaaatgcaactctttataaagtgtcttggggaagcagtcaaatgattacttggagcaaggataaaagaattacaacattataatgagtgaaaggatgttttaaatcactataatttgttcacacagaaatggattcctaaagttatacataaaaattgccttcaagttatagctagagttcacatccgcttattgacaccaacccctaaacaacgtgctgaccatttccatcgttgtgtggagactttattctaaaactttaatatacagctttgacatctgaagagattttggaaagaagagcggaaactcgtagtaaaagggcttactgttttacctcattgcttttaagaaggcctcttacaagtctttacacgaactatgatattgcatctctgtgctcaaagaaaatgattggaaatgaatcaaaattggagtcacaaaccaaaaattggagtcgatcatattcctaaaccaagggcctaagtattagggattttaatttgaattaacatgcagatatctttttaatgtttttaagatattcagtaaatatttgcaacttctgttttgttttcatttagttacaaaaaaagatgaagtcaatgttaactcactgaagagcaagcattactaaaatgccacgtttaaaatcattttacataaaaactattattaagatctaatttagaatgatgtgtttactctgaattttgcataaattgccacgctggtttgtcacggtgctttgatcgtttgtctactagatattgttctcacagaccatacaggctgatacatttgtgaatttaatcatcttgtacaatacaaaacgtatggtcacacattcacagtaactgaattcagatgtagcaaatgctgacaaaaagctcctgaggatctttcatgacctaggaattaaacctaatcatcaaacaatgcttgcagactcatcaaagtacaatactctgccaccaggcctcttgacctttcaaggaggcgttgccaaaaggcggctgaggctgcccgggaacatttaaatgaagattttgaagaagattgaacctaatgttaggagattatctctttattatctggcacaaagcaattgtgttgtggtttttgaggtttttcttctttttttttttcattttcagagtactttattacaattaggaaattactactcactgcttcttgtgtgttaaataaaaatcatgctcattttacataaaaaatcacatgagttttttttttttttcgttttccataactaaaatgaaaccctgtaaagggagtaaaccctgactttgttttttgtttgtttgtttgtttgtttgagatggagttttgctcttgttgcccaggctggtgtgcaatggcgcgatctccgctcaccacaacctctgcctcctgggttcaagcgattctcctgcctcagcctcccaagtagctgggactacaggcatgctccaccacgcccggctaattttgtatttgtagtagagacggggcttctccatgttggtcagattggtctcaaactcctgacctcaggtgatccgtctgcctcagcctcccaaagtgctgggattacaggcttgagctactgtgccaggctcttcgttttaaaactattttttatactatcttttgaatgatgacttgctcatttgtgaggtgttttgcttctcaaaaggaaattttctttttgctgggtctcaaagccatggtacatgaatatgcttcctctcacgtagtcagtactgaaaactggcaggcatacttcggtaataccaagcaaggagactgcaagtaccattctccaggcacatacaacatgaaatatcatacagctgtgaaagatctggtggaaagctggaatcttgaggaagaaacattttttgaaaattatttctctctctaagtcagtaaatgtttgatataattctgagtgcatggctgtagtctgaaagtttatgtgcccctaaaattaatatgtcaaaatcctaacacccatggtgatgatatcaggaggtagggcctttgggaaagtaattaggtcattaaattaataaggaaatcgtatccttttttttttttttgagacgtagtctcgctctgttgtccaggctggagtgcagtggcacaatcttggctcactgcaacctccgcctcctaggttcaagcgattctgctgtctcaggctcctgagtagttgggattacaggagcctgccaccacgcccagctaagttttgtatttttagtagagactgggtttcaccatgttggccagcctggtcttgaactccagacttcaagtgatccacccgcctcaggcttccaaagtgctggcattacaggcgtgagccaccgcgcccggccatcgtacccttttaaaataggcccggggagcttgttcattgcttccaccaagtgaggatacagtgagaaggtgaggtccgtgaacgaaagaagaagccctcaccagacatcagatcacacagcagcttaatttggggttcagccttcagaactgactgtgaaaaaaacattttgttgtttacaagctactgagtttatggcattttgttatagtaacttgaaaagaccttaagacaatacataatcatctatatctacagcatattttctaccagattttaatgccactagcttaaaaatgcaaactagcattatgaaatgttggccaatattagttactatttatggaatgaatgtttaagtatattttaatgttcaagcagtatttaataatcatctttacctattatgtaattctgacaagtaaattaatattactcattagatcagagtttagattactgagatattttactcttcgcttattttttgaattctgtactataaaatgtaaatagaattctgaccacactactccattttctaacctttcttactttccattctccttttgctcttatctagtagtaagctttttaaatgaaatagcaagccccaaccagacatgtgatcatataagtttaccaaattaatatttacatacttcaaaagataatttttaccttttgcaaggctcttgtatcggttggaaccccgagaacgtgccaacagacaacaggaggcggtgtggagctacaggctgttttaacgagcgcctgggtgcagatgggctgaggcctaaaatggcgtcagcgtcaagtgaggacggggcaggggttttatagtcctctgtaaacaggaagtgtccgagtctgaagtgactgctacgtagtaccttgacagcttccttttcgatcttcagcgggtatgtgtctctcggccagctttcttcctgtttctgctatcttcctggggcaagtggccttgagccttggggctgggcctgaggagggaggagatatccattcccttaagctttcaggccccgggggagaatctttcacctttgaaatgcctgaggaaaaaactatctttttaaaattttatggatttaaacattttctgcgtgattttgatttgattccacactgaaaatgttttctacaggaaactgtagagcgtttagatcaaatgctttttccacctaggcagatatttgactttaaatatacatatatatataatatatatatatatatatatatatatacatactatatatatatagtatattgtacttctctttatctttccataactccactctgtagtttattaactgtgaaacgacatggaaatgagagataggcaattatttgtatcttctaggaaaacacaatcaagttggggagccatgacccttaaatgtcatgactgatacacataaaaaagaaaggacactttaggaagtgtgtgccatggggtgcgggggaagcctcagttgatctcattgggaaggatggaagcttttctaggtagctttaaagatcatgatctggaattggacaagctctgaagtttcctattacaactaaccattatatacttgttatatatatgcttattatatacttgttttcctgtaatcagctggagagagtatgtccattcccatagactcactgttaagtgccattatcataaagctgctttgtgttcaaaacacttttaattactaggaacaatatttataagatgggtttgatttttagttagttattataactttcctattataactaactccccagcctacatatcttctatttcttcccaacattgcatattccagcaattgaaaattatcacagctaaactttaatttgaaagagtagaaagacaatagttaccctcactgcttatctgtaggtaatgtgcctacagcaagatagaaaactatatcgagtctcagaagaaggagcaatgcagcctacaaatgattcagtggtgactaggatttgtttttattactggcattatgaaatagaatgcatttcaaactgtgagtcctacctctttctaattattttctccacactttttctttcctgcactctatcttccttttgatttcctaaatctgtttcttcattctgggaggcagcctacaccaatggttaaatatttgttagtaaatgtcatggtgtgctgaagagtagcattttaaagttatagtaatttatttatgaatacaaggttagaagacaagtcaatttacctcaagatacttgtttccctgtaatcaattgcagagagtatgtccattctcatagactcactcttaagtgccattatcataaagctgatttgtattcaaaatacttttattactaggaacgatattttaaagatgggtttgatttttagtacgaagaacctacatttcatcttttaaaaaggtatcttctaaaaattttctaaatctagtttcattgtcccaaaagcatctcacaagattttaaatgttttttatgattagattgttgcatcaacatgctatcagatcctaagctatgtttgctagttcttctcctcaggtacattaaattaattgagcatattgtggcctctgcagcatgatgttttgctagtaaatgattcatgttgcgtcccaaccacagtgaacagcaaactttcaccagaaacagatggaggaatgatcttggccatttgtggcaacctcaggttcatctaggaaaaactgaagttcatttaaaattgacctcaatatgctgttggccagatttgattcacctcaggtgcatggttctactgagaaagtaatcagcaccagcagatggccctctctaggctcactttcctaggcaattaaaaatctgttgctaggatatataactatcaaatatttgatatctttacgtggcagcacttcccctcaatttatgtgtcatgaaatttttttcaagaaatttctaacaaagataaaaatctgggttttggaatataagtgaagcaaatgcagtccccttccctttgtgctgaactactttcccgcagtacataattttcccctggttactcagattttattctcattaaaaaaaaaaacagctagcaaacttttccctgacttttccatatcaaactgtagttttatgctatgttaagtgatgatgtattactgtacttttatttaaatataatagtgctgccaatctggtagtgagggatatattatgagctgtatttttaattgacagtcactgatccaacagagactttctcttattctcatgatcatgaacagaattttatgagacagatgcccagaccaagtggcaaagttaaacagggtccatttatataatagaatttatgaagtctaatttgtgccaagtagataacttgattagatggggtaatgtgtcaaatgggcaattaactattttatgagcaatttttttcaatggaagtttttttctgtgcaaaagctatgaaacatagaattatttctaaatcagacaaagaatttagctttatatgctattaaaaattctacaaataagaaaaaatgtacaggaatatgaatgaccatgtgaatgcaactgaaattatttgatcaccttcagtaaactattcaagtagttgttttaaaacaaaaaaagattcttaaaacccaatttaggttagaaagcagttatttttggaaattgccatagaagttcattttttatttagccaccatttgttgagtacctatcagggccagcttttgtccaggtggtaactttgtggaagctagattaaggcgcaactccaggaagacacagtttgcagcagggaacagtgcctgcaaacagagcatatactggaattcaaccatcattcaccctcttgaagagatactcttttcactgaacaactggtacaatgtatgagatgatccctggcacctactgtatctaggcactggaaggttaatggtgagcaaatcggttattgtccaagccctttgaggacatgcagatatgtaaaaaggcacacattaaagaaataatcgtacaaataaacacacaattacaaagatgtattagatgttttgaaagaatagatactcagagaataatactagaaaagtttcattcatgatgaaagatcaaggtagtcttctctgaggatgtgatgcttaagctgacatttcaaacatgagtaggagtcaagtgtagagaggagaatcttctaaaaagtgggaacagcatgttatgacctttgggttgaaaactttcccatattgaaggaacttaaaggaagtttcagtgcctggagcataatgaacaaggctggagttttgttaagtgaggtcaaaatcactccagatcatgtagtatgtgttaagaactttagattttaacctaaagtcaaaggccagatgctgaagggtggtagggaggaagtaatataatcatacatgcgttgaaataaaatctccctagcttttgtgtgcaaagtagattggaggaaggaaagacaacatgcaaggagacagtgaagagatttgcagtaatacaggtgagaaatgatggtgattggtctaagaagctggcagaagtgatgggtagaggttagaaatgaactccattgacctttgtgatggactggagttgtcacagtagatgccacaatgtgagttattagcagctggatgagtaaagataccactgagggagaaatgatttactggaggaggggaaggcttggataacagatgttctcttcatggagatatttgtgagatgtgctgaaagatacatcaataggcagttgtgtgtgtgtgtataaatataagtgtgtgtgcgtgtgcgtgtgtggcctttgggagagggctgttactaggtatattagagtgaatgttgttaactcctgcatgaaattccaagttatggacatggatgaatatacctatcatatagtagtaagccaaaagaaaatcaagaaaattgctgaaaagtcataatctgagaggactgaaagaaaaaaaaaaatagcagagagcgatagcatagggcccaggagcataaacaggcttcaacacatctgttaatttgaatgcagctgtggagtcacataaaagtccattggatttgccaactgtgggccttagaagatcttagaatagtgaagaaatgtgtataatagttattgaaggaaactaagagcacatgttaactggtaaatgtaggtaactttgacagcccatgtagcaagaaaagttttgtttcattcgaaaaaactaagagaatggaaaagaaaatgggtggcattagcaactgcttcagctaagagaaatgtggtcccgaagaggattagaaacactaatacaaacttcatatatatgtgtatatacctattatagggatatataaatttatatactataaatacatgtatagtcataaataggtatgcatatatatacatatatataaagaaacagagggcacataggctggggagtggtatttttaaaagctttagagcttgttcaaagtattggagattatatatatatatagacacacacacacacacacatacacacacacacactcacacacatacacatgtatatatataatgccttaatgcacgtttgaacattaaggggaaggatctagtattgagaggtatgtttaaatgcaggtgaaagatgtaataatcaatggagggacatccttgaatctttgataaaggaagatttagagacaatatggaaagccaggcttttgtcacaaagagggatgcttctgctgtttttttctatttttaattttagtttgaaatttttcaaattgagaatagatgaaaacatagagcagtggtctcttatgtaaccaccatagatattcactaattggttgcattttgccacatttgatttatatagatgtgcatgtatatgaatacctttatgtatatgtgtatattttttcttaatccacttggaaataagttacaggaatcatgacccttcatctctgaaacttcagcatggtttttccaaaattagaatatattttggaaaaataatacagaagaaatgtaggctttgttttagtggaggaaagaaagagagggcaattataagcagtgtggttggtggtgaatactcattggcagtacagagaaaccattttgctgatggaatgaagcaacatcattcaatgagaataagggtagggagattagatccaagatcttagaagagtcaagaaaagtatataataggaaggttagatccaagatcttagaagagtcaagaaaagtttataataggtattaagggaaactaagagcacatgttaactggtaaaagtaggtaacactgacgggtaatgtaggatgccccatagaagctggtaatcatcagtttaaataatagataaatgtgattgcttagcaagtgagttggaaggataccagaatatgatcagagtgctatgcttgactttgtgtagcacttgtaacgacaagtcagtaaagattgaggcaaagatgttctagaaaaaagaaatagtatgtaaatatctgtgaatacaagaaaactcatgactaattcaaggagttaaaataatagataagtggtaaaagtgaagtgggaaaacagggcacagcagaacttgattaagtttgttcatgggcactagggataagagcatcaacgaagtcgtacaatgtaacaagaagatataccatagttgggagaaaatacgaacatatttgtaactctacttaataattttaaaataaaactttgtagtaaaatgtattatactatgatcagagagtggtgttagaatttgtgacgctttccatggagacaatatctagcatgccactctgggtatggaaggaagggacacagtgggagaggattgcttgagataagatgacaaaactgaagagccaagtggttagactgattgcttaaagggaaatcaatattatctgtgaaattagcagtaatgggatgacagtagaactatggaccttcataggatgccagaaacttctagagcattaatgtaaggaggatattacagtatcattgcttcctggtacatctctgaaaaaactattaaataaagaataaaagaggggacatttatttatttattcactcatttataaaataaagtaatgtcagtagtctaagggggtcacgaggaaacctccaaacatggtcattcactaggaaaaagagaaaaatagctgcagagagagagaaaaatgtcaagtttcaaacaagatcacaaggcagaaagattaatttaaaaagatcttgtggctatagataattttgcattctcatttgaatatattttctggctgtttttcttttcatttaagatgtttaaaagcagtggctaacaagtaatcaagtacatcagcttttcagacttctgacataatcctgcaaaaggaattagtaaatattgagatgtcaagaatgagtttttaagctatgctgagtaattaagcacgaccatgtttaaattctgctggctttagacaaaactctatatccaggaacaaattaaagataatcaatgttgaacaccctattttgtgcaatactgcaataggtgaccatggagaataaagtagtcatgccatttagaagacatgtctggcagcacagagccagataaatcacttctagtgaaaatgtcctggtgaaagttttatgtacatttcccaccttgccctggtgaactatctgcacagtctgactttactaacattgtagatttcatatacatttcaggattatttatttggatctattcaaatgcatttataattttatataattataagaaatgtttctcaaaatttcttaactttttagacattactctgtcctctctagccttacgtgcaacaaagtcaattaacatttaccatatttttatattccaaatgcctcatttttagatatacatagcaactatggtttattactttatcctgtgattctttccattatttttatgatatactgtacaaacatagataactctgtaaatcaaagtttaccttcatcctactgtgtagatagtaggtaaataaaagtaatctatgttagataaggttctaaagaaacaagcaaatggtatttaacaaagcttgaattatagttccttttctcagaaacgatttcttcaaagtaacctaaagtttcttatttccctacaagtcttcaacactttgcatattagttgcttgtatatttctaggaagtatactcatgtatttattatgtacagatcatagaaaggaaaggtttctttacgttaaactttgaaaaccaatcaagcaaaatcttccaggttaacaagcatctgttgagagccatctgtaggtataaattcagaaatgtaagcctcaatggaaattgcttattttaaaaaattccaaagatggttcgttaaaggcaaacaacatacaggcacacacacaaaaacaaacagacacaggtacacgtgtctatttaaaaaacatagggtataaattagaaaatataggagtaatttttttcagttacaaaaatcacatatatatgcctgatctactcatattaattattagacagaatttcactcactgaaattgagtacagaatttaactttatgcagcataaggaacttcagggaatggaagtttacgagaggatctagtgatagtgaaggatcaacagggagttgattatctggagcataaaacaagatgatgagcatatggccaatgaataacttttgacatgggactgacttactcttgagaagtataaaagtatttttactcgtgttcattgcttttgaatttctgtttcaaacaaaaaacagaccacctggagctatgagatacgatgaatggtaaaaataaagttagtggggtaatccactatttagatgttcccatctctaaaattatttgcttatacatttaatcaaaatatttataggactaaatctcagatatagtcatacttaagataaatagaaataactgtaaattttcattaggatgtattttatggattttttaaaaaaagtgttcataatccagaaagtaaaaaccatctgaaattgaaaattatggtttttaattaaagattttaatatactttattagtcaccttttcaagtttactacttttcaagtttactatcaaaagctagaactcaatacaaatatggagcattaccttacccttattactatactaataatagattttttctcgtttgatcctcagtcccctgcaaaatagatgagctaggtatttctattttcagttaatgtcccaacaatcaaattttgttcaagtacttggagaaatggctaggaatatttataggtttccaaatgattgagttttcaatcttctcataattactgtgtagttgttctgtaaaccgtagagtgttatgtaaatgtttgctatattattagttaggctcttccagaattcatcttccaggaaaagatgaaatacatatgctctagtttatattgataggtcatcaaggaacatgacttatattgagcttcatgtagaggattaattaatattcaggtgctcgccttatcaacctgtgcagtctagcttttgctgccaaagaggattccaaagaggttaaggaaaatctggactatatgtcttcagagtttttcaaaatacaattccaaacaactttaacattttaaggcattaatgatttgtgtttctaagttttctgtaacctttgattatctcttcattgattgtgccatctttattttatgcttaatttgtactggattttactggccactgtatattttatatactttctctcagttaattcccccagcaaccaattacgatattatgagatgatagataaatctatcatcaaggaatagctcttacaactttattaaagtggaaactgaaactcagagaagtagaaagttaattgtccgttgccacacagttaataagaagtacactagaagcagaaaccactattttattttaattccaactcctcttcttttcccaccacatcatagctgttctcaaaagacttatcagtgtctttgggagagaaacacattcaatgacttactatgtaattttgtgattgagagaatgacccatgtggcaagttaaaaatgcaaatatatttcctttacaaacataatttaagtatagaatggtagcactgttttactattttatgagatgtatattatgaatgggaattggaatcctggtgcctgaaagtatatcaagggtattaattgtgatactaatgtataaaagaaaaaaattcaaatacccatgggcacacatacttaaacatcatcttctagtgatactcattttttgaatctcttatgaaaataaatcattgtcaagaaaaatgttgccaacacagatatattccactagttttcttattgctaatgagcacatgctgcttcataggagtgatcagtgtgttacatgcaactgcaggtagatcagtgggatgcaagaataacataaagcttcagagaaggagaaaaaaaatagcatgtatacaaacaagaatccactgcattaaaaaaataaattctgttaaaaattcacaaactagaataagataaacaaaattaaataaacagtctcatgtcatcataaaagacccaaaatacattttccttataaatgcaaatattatgtgttcgtaatatggcttgagcatgaaaatagaggattatggtaaaaggtgaaaattacctttaaaaattatatatgacatttttgtccgggcatggaggctcacgcctgtaatcccagcactttgggaggctgaggcaggtggatcacgaggtgaggagtttgagacatggtgaaaccccgtctctactaaaaaaatacaataagtagccaggcgtggtggcgcatgcctgtaatcccagatactctggaggctgaggcaggagaatcgcttgaacccaggaggcggaggttgcagtgagccgagatcacattgctgcactccagcctgggtgacagagcaagactctgtctcaaaaaaaaaaaaattgtatatgatgttattaaatatattctcccatcaataaataatattctcctagcaattaaagcttggtaaacaaacacataagaagaataagccaaatcatctgatctgaaataaaggtcatagtaaataattcgtattatcaatatacatctattttgatataatcagattcaccttcctaccagtgtttttattgtgtcctacaaagcaagtattgatgttgatcttccttaaaatctgagcttttacaaaccaattgcttgtttatatctttctttgcctccaagatggtgcgttatttcaaacatgttcacatttgttgaatttgtacataatctacattaattttttacatttgaatagaaataaggtgaattacctcaatttatgcaattcatgcctctatcatggtttgttagatgtttgattgtagtacactgggtctctgtatttacttccccatgttagagaaggggacaagccattctgaacagagcattggagtaggaatcagaactcctgggttccagacatggctctaccaatagtttgtgtcccagggaaagatattctatctcgttgtacctcatttttcttgtctctaaagttaatcttcaaaggattacataagttgttctcaattctggctgtataattacctgacaaacttttaaaacctcctggtacatagtccccatttcaaatatattaaatcagaatttgggggagtagtgcaatgatatttgtaaagatcttcttagttgattctatatgcagaattcattaagaaagactatttttaggtacggggacccattagctgttggttgtcttgaatgaggtttaaccaggcccacaagacttctgagtaccaaaggcatgtataataatttagaagatggtatgcatatgggcaaaaatgttgtgtcatgtatagcacactccaaccaaaagaagtcttgttaaaacaaaattcagcgaaagttgttgcttacctgcttagagcaaagaagtaattgtaatgagtcattataaaatctatgataaaatccatgtaaatatgaagaattcagtttggtaataaaattattatcaaatgtagaaataactatatatgaccatatgtggcctgtaaatggagcaaaaattatatttatttttagtaaggttttcaagttgctgttgtgacataaaatatgaaataagaaacatttctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaagaaacatttctgaggccaaatccaatgattctgttttattggtgctttttaagtaaatacctccttatactttctgaaatatatttttttcacatttggtgagaactctattagcaacggtctggaaagtgtctgccatatacaagccaaccctaattagttttaagcctttgagccttatttttaatttggtgaaatccacgaaaagtttccaggtaccatttgaagatgtattaaaaagactaaaagctccaaatatcaagatggtcttgctaaagttttttgtttgttttgttttgttttgttttgttttttgagaaggagtcttgctctgttgccaggctggagtgcagtggcaaaatctctgctcactgtaatctccatctcccaagttcaagagattctcctgcctcagcctaaagtttttaaaatttatttaactgtttcctttatacatagattggcatatagacacttgagactatccagtgcggatgatgatgatgatggtgctggtggtggtaacaatggtgatgctagtgttggtaatgttgatcaagatggtgatggtgatgatggtgatggtgatatggtaatgatggtggaggtggtggtggtggtggtaacaatggcgatgctggtgatggtgatgttgatgaagctggtgatggtgatgatggtaatggtgatggtgacataataatgatgatggtgatgatggtaatggtgatggtgacggtcaagaagatgaggatgcctcttatcttttaccttgtcaattacaggccaaaacataaagagacatatcagctgcatcaatagtaaacctagttatgcctacaaatattttcgatgtcatgtaatttttgtgatgtttttaaacatgtgtaaaactacacttttgtactaaggatatgatagtatatcataccccaaacatcatgaactgatgaaatctcttgaaatattctttgaggataacaatttagcaaacagaatggcatgtataaacttcagaaatcagtgaaaatgttcctctcttaagttagtttatgtttgggaattgcatcagtgttttcttggtatgttattcctagccccagcttgaacctaatacttggaggataagtaaatgggaagaagtagttgacttgtcgtgtaggactgaagaagtaaacaatgagattggattctaaagacccaagtagctgggatttgccctaagagagaacagtctcccagtctgagagccccagtctaacgttagctggaggaagaagaggactgttaccagagatattcaaccagaggcttcacctattgtgatgtttaaagagattcctgccacagctgaaagttattttagacaacttctaaggtctctttcatttctataatctgtggttaatgatagaagcctaatcttttgggtaagatgcttcaactatataaaaataaatgtcatagtgatgtagtttgacactttctttgatatattgcaataactctgacttctctttttttaatactttgtgtttgatgttggaagatagaacagagctttaagtttcacttttgggttttttttaaaggccttgataatatttcaggatagaaagatacctaagcagatattagtcattttgactaatacatacacaactcatatggcaatctcatcaccaaaatccaactaagattttagttattgtgatgtaactaaatgttggggctagaaagggcaattgatttgtgaaagagaaatgtccattaatttaggagatactaaaacacagaatgtgtagttttgtgctacaacaccctctctgataataatcacaagcttttcagaggtttaatttcagaagtcgtggtaagaataatgactatatttaaggagtctgaggaacagctttgcaggcattatattatttggtcatcacaacaactctttattctattgtcttcatttgacagaaaggaaaactgagagttggagttgataagtacctcaaccaatatcacattactgtgaatgacaaagcaggacttggaatgcaggaagtcagcctccatcatctgcacctcttcccccacattccacaatctaagttggcagctcccatgcctgcattcatacctctagttactctgtcttcctgatataactgcactgatatggtttggctgtgtctccacccaaaatctcatcttgaattgtaataatccccacgtgtcaagggagagatcagatggaggtaactggatcatgggggcagtttccccatgctgttctcatgatagtgagtgagttatcatgagatctgatggctttataagtttttaacaatgcctccttcggtcattctctctcctgccaccttgtgaaggtgttgcctgtctccccttcacctttcgccatgattgtaagtttcctgagtcttccccagccatatggaactgtgagtcagttaaacctcttccctttataaattacccagtccctggaagtttctttggtggtttttttttttttttttttgagacagagtctcgctctgtcacccagtctagagtgtagtggtgtgatctgtgctcactgcaacctcctccgctttccgagttcaagttattctggtgcctcaacctccagaatagctgggactaccggcattccaccaaacccggctaatttttctattttttgtacagaggggcttgcaccatgttggccaggctggttttgaactcctgacctcaagtcaggatctgtccaccttggtcttccaaattgctgggattacaggcatgagacaccacgccctgctgggaaattgtttatagcagtatgaaaatggactactacatgcactgaaaatgaggcatttctgcctaccagttaaactatattttacatatgtgcatggtgattattaaataacttttctattcctttattcttcagattcttttcctttttcttatcgtcaaataatgaaaagcaataacacacattagtaccaggccttgccccagtttatctctcatcatttattaagacataaacaattaacttggtgtttatgtggtaaaggtgaattaattaaaggaaacgacaaccacaacaacaactcatagccaaagcatgctgttgccgtaaagatcaaagtcagtgtttggacttcagatttttcagagttataacctcacggaagaagcataacctcagattttcaaagtgaaggttatggctgaatattcacatgagtgatttttttttcattctgctttaaggacctataatatcctaaaaagaatatacattatataaaatggtagcccactttttagtgactattgcaggaattaaatagtatcataaaaatataatttcacgtgacataaactgggagggagaatgttttcaggaagggtaatgtatgagtacatacaggttattcagttcctcttaatgacttgaagaacataacagttctaatggaaggtatttcatgaacaacactgctaggcaccagtcaactcaaaagatgtagggcaggaggctaggtgcggtggcttatgcctataatcccagcactttgggaggctgaggcagggggatcggttgagctcaggagttcgagagcagcccaggcaacatggtgaaacttcgtctctatcaaaaatacaaaaaaaaaaaaaaaattagccgggtggtggcacgtgtctgtggtcccagctatgtgggaggattgcttgagcctggaaggcacacgttgcagtgagccgaggttacaccaatgcactccagcctggctgtcaaagtgagatactttctcaaagcaaaaaagatgtaggacaggaaacaaagcttctgaacagggcagtattggaagttcctgctcagccccaaaagttttgtagccatccatgtagcccagctcagaagcaacactccattgggtggtatcagatattctggcttagaagcatcacatctcaaagcagccagtatgtctgtaggtctagttttatgggcagagctgtatccccaaaacttgtatggtaaagacctcagaatccccagtacctcagaatgtgactgtatttgtagatagggcctttaaagaataattaaggtagggtgaggtcatgtggatggaccctaattcaatataactagcattgttttttgtttgcttttttgtgttttttgtttgttttgtttttgagacagagtctcactctgtcgcctgggctggagcacagtggtgcgatctcggctcactgcaacctctgcctcctgggttccagtgattctcctgcctcagcctctcaggtagctgggactacaggcactcgccaccatgcccggctaattttgtatttttagtagagatgaggtttcactatgttggccaatcttgtctcgaactccagacctcaggtgatctgcctgccttggcctcccaaagtgccgggattataggcgtgagccacaacacccagctatgactagcatttttaaagaagagattaggacacacacacacacaaacacacaaagatcatgtaaaaacacaaggaggagaagacagctatctagatgccaaggacagaggcttcagaagaaataaccttttcaacatcatgatcttagacttctggcctccagagctgtgagaaaataaattatagtactttcttacagcacagcaagcaaactaacacatcttggagtcaacatctccacaaaggatatgcagagttacaaaagccgccagcctcaggcaggccctacccatttgactgactaccctgtctgagtacccatttacagatcctcctgaatctaaatgcaatttactaatccgcagtctttgtaaatattgtttttaataagcaatgttgaacactgacgtatgtaacagtgcaatttgtgtctggtttctgggagaatgaggtgaagtgttaacgggaggtcaagttctcatccagctggggaaaggctttagtatatcctttgcccacatcatagcagcttcttttatgatgggctgaggtgagaggagagatgggcaagattttggccatttgatgtcatttgttctctgtaagacactattcttaaggtagaagatattacaattttagtaaattaaaagagatttccaaaactgaaactttccaaaacctgtgactgctacagcacattatcggggcaacatgtttcagttattttcctcagagtcctcccgggaagaactctctgaagagctgacttttaaagtgagtcttaaatgacggcatatatccagtcatgggaataaactctgtcctggcagggaactgggggaggagggctctgctattggtccatcaagagccttcctgtgaatttgcatgaggctgtggattcctctgggaaaatgcagccctagaccagagggtgcagcttgtcgaggcacacagtgcacagggtgcatttctgcaccccatggccactcagctgagcaaccttctgcgtgggccaacctcccctgtcacataagagacatctgagctttaaaaatagtagctatgaatctctctgaaatgaattaataggaagtgtaacatactggaaagaaaatgaacaagagagtcatttgctgtatttgttggctaattggaaacggagctatttataaccagtgaactgggtgattattggaagaagtaaagaatttaaatagtttaaaaaagtaaatattagaatttagccatttgatagtatgtctttttcagggatgatagggaaaagacatcatagggtatttgagtcagaagaagcaacgtgaaaagcaaagcttgatcaccccagcaatggaaaatggcccgtgtggctaaaacacagtaagcagggtacagagccagggagggggtgcagactgtggtggagaagaggggtgccagtggagaggaggtgaaaagatagtcagggacttgtatttggattttatttcaagtgcaagtcattgaaggattttaagcaggaaaataacttggttgtttttttcctcttgctttaaaaagatcattctagctgaaacatagaaaatggattgaaagtttttagagttgacacttgagatcagctaagagactgctaagttatccactgagaaagaatggtagcttgaactctgatcgcagcagtagagatggagaaaagtggacggatcagagacatctttggatttagaataatcagaaggtaccatgctatgaagaaaatgtgaggtgaaaaaaagaagtgtttattctcaatttccttctttgaacggtctatgtatagcggtgtcatttactgaaatgggcctgccttagtgaagtatagatctttttcttttcatttttccctttttttgttgttgttgttttagaagttatgaaaatccttgatgtgcactgcatgattctggcttcactgggcacactgtgctttgttctccctccactttccaaaattactttatgtgaaatttagaataacatatatcctatatattaactatagaaaaatatgaaaataaatttattggtcgagtagtcctgtcaatttaatgactattgataaaaagaaagataagacattactcaaagcactactacttcctattttattggatggagtttacatagatacattgcataatcataaagcaactaagtttcctaaacatgtgtggatcccttcatattctaaggaaggcttaaactaaggagacagagttcttgcacaccgggaagcatacctcgagaaagatgatatgtacacaaaataatcaatatgcacaatttatgcagtattatatattgtgcatatatatgataggtacacaaatattgcatatacatttagatgacacatacataaatattctgtatatttagattcaatagttggtacatacacagatactgcatatattttgttaatacttaacacgcactgcagatatttgcatatacttaacatgcactgcatataccctaagagagtgcaaactggcattgatgtgcaaagtaatagagaaagagacaaacaagaatttttttttttttttgagacggagtctcactctgtcactcaggctggagtacagtggcatgatctcagctcactgcactctccacctctggggttcaagtgattctcctgcctcagcctcccaagtagctgagactacaggcatgcaccaccatacctggctaatttttttgtatggggtttcaccatgttgaccagactagtctcaaactcctgaactcaggtgatccacccaccttggcctcccaaaatgctgtgattataggcgtgagtctcccaaagtgctgtaattataggtatgagccacagtacctggcccaaactagatgtttgaatagagaggttagcatttgaggaagcacgtaagggatttgtgtgattgtgagatggaaataagagaaaagagaggcaaaaggaacaaaacaaatgatgagtcaaaattttaaaaaatgaattttatgtccagattacaagtatcctagtttggctgaaccataagtgattttggggaagaatgtgtggctaggcatgaaggatattaacaatgctaagaattttggcattatgctacgtgcaacaaactcattgaagattcttaagcatttcaaacatttttcaaaatatttttcagtggttatacattttaaataggtactttttgttttctaccttttatatgttttctatcctgcaattttctattgctttaaccataatcttataatttattctctttttactttatgtgctcctttgcttgtctcactttctttccctctgtgtgtgtttctttcccacatacactttaggattaaaaaattacaggtgttataaaaatcaatatagttgaataattacagatgatataaaaatcaatatgaataaatgatggattgacttttaaaaatagcaactatgaaactcaaatcaattaatagagtgcacagcctactccaaaggacaaataagagtgtattcaggctgggcgcggtggctcacgcctgtaatcccagcactttgggaggccgaggtgggcggatcacaaggtcaggagatcgagaccatcctggctaacacggtgaaaccccatctctactaaaaaatacaaaaaattagccgggcgaggtggcgggcacctgtagtcccagctactcaaaaggctgaggcaggagaatggcgtgaacctgcgaggcggagcctgcagtgagccgagatcgcgccactgcactccaacctgggcgacagcgagactccgtctcaaaaaaaaaaaaaaaaaaagagtgtattcagcatatttattgagtaattagaaatgaaaataacgtttatagccagtgtacttagtaaatggattatttgaaaaataagtgaagactttaaatactgtaaaaggaaagcagataatagaatgtagccatttggggacagtaaggaaccatgatgcttcctgcctctaatctcagtggttttagaggccaaggcaggagaattgcttgaggtaaggagtttgagaccagcctggacaacatagtgagactctgcctcaacaaaaaattaaaaattagatgggcatggtggtgcatgcctgtagttctagctactgtgcaggctgagggaggaggatcgctggagctcaggagttggaggttacagtgagctaggattgtaccgtggcgctctggcctgggcaacaaagcaagaccctatctctagaaaaatagaaataaaaaagtagccattttcatgttgttatgaaacctagttagagctcttctttcttttactgtctgctcctgttttagtaatctctaaacagcttattaattatatattttcttatgtattttaataccctactgatgagttgatgatatatttctatttcttatctcaatctgaaagttctgggtaaaatcttttgtgcaattatttagcaacttatagagtcattatatgatccagacaccccaggttagaattcagtttttattttcccacctctgttgtttgggagtagttcctaaggcaacaagaaggaagtagtcagcatataggaggagaattagtaaaaatgaaaatcacaatacacacatggtctgagaagtttgctttttgtctaataggatataactttatttatattgttttggtaattcttaagcaaatatgccactttgaaatgaacatttaataaaaattcatttactgagatgtgtagtgacatacgtgaagtaattgagtaatgataaaagaaagaaaatcatattggagcatctttaagattttccttggataatgaataggtattacctccagatagaagaaatgatttaacccattttggagaaacattatcagagtttatctagatattttacaaaattattttatccccccaaactcacagctgtttctgtctcttctttcacagtgatagcacattatttgaacagaatgagaatatttacttgtctttcttagttgaatgacacatttgattactgttcacttatcttgtctaccagctccattgagcaaagaaagggtacaaatagatatcattttatattctcaaccatacataaatatttttatattcatgtaacactgaactaatagtaatatatatgtttacttagtatgtgtgtatatatatatacacatgtgtatatatatgtgtgtatatatatgtacacatatatacacatgtgtatatatatacacacacatatatgtgtgtgtatatatacacacacatatatatgtgtatatatatacacacatactaaggcatgctaatcgtgaagaaatgttacttctatgatatgactttcatagtttatttgtgtgttcttcaaggttgccctttgaagccatcgtgaatatgtcattcaatgatatcaatgactacattagtactaaaaataacttgaggctgattttttaaaaaattgatttctattgagatgtcacatggtgtaatgtaaagtgaatgggctttggagcaaaaagacttaaactggcactgtaacttattagcactgtggcatttggttccaagccttggttttctcatctgctaatgagaaaagcaggacctaacttataaaattgttataagaattagagataataactgtttgaacagcgcctgacaaatatatcataagcattaaacaacttgctatttgagttctattttctttttttaaaaaattattattatactttaagttctgggatacatgtgcagaacatgcaagtatgttacatggtggtttgctgcacccatcaacctgtaatctgcattaggcttttcttctaatgctgttcctccgctagcccctcaacccccaacaggctgcagtgtgtgatgttcccctccctgtgtgcatgtgttctcattgttcaactcctacttatgagtaagaatatgtagtgtttggttttctgttcctgtgtttgtttgctgagaatgatggtttccaggttcatccaagaccctgcaaaggacatgaactcatccttttttatggctgcatagtattccatggtgtatatgtgacacattttctttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaattatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggatgaactagtttgcagtcccaccaacagtgtaaaagtattcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgttggagttcattgtagattctggatattagccctttgtcagatgagtaggttgcaaaaattttctcccattttgtaggttggctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacatttaaatctttaatccatgtgacacattttctttatccagtctatcactgataggcatttgggttggttccaagtctttgctattgtgaacagtgctgcaataaacatacatgtgcatgtgtcttcatagtagaatgatttataatcctttgtgtatacatccagtaatgtgattgctaggtcaaatggtatttctagttctagatccttgaggaatcgccacactgtcttccacaatggttgaactaatttacactcgcaccaacagtgtaaaagtgttcctgtttctccacatcctctccagcatctgttgtttcctgactttttaatgattgccattctaactggcgtgagatggtatctcattgtggcttttatttgcatttctctaatgaccaatgatgatgagctttttttcatacatttgttggccacattaatgttttcttttgaacagtgtctgttcatatcctttgcccatgttttgatggggttgtttgtttttatcttgtaaatttgtttaagttccttctagattctggatattagccctttctcagatggatagattgcaaaaattttctgccattctgtaggtttcctgttcattctggtgatagttttttttttgctgtgcagaagctctttattttaattcgatcccatttgtcaattttggcttttgttgccattgcttttggtgtgttagtcatgaagtctttgcccatgcctatgtcctgtatggtattgcctaggttttcttctagggtttttatggttttaggcttcacgtgtaagtctttaattgatcttgagttaatttttgtagaaagtgtaaggaagcggtccagtttcagttttctgcatatggctagccagttttcccaacaccatttattcaatagggaaccctttccccattgcttgtttttgtcaggtttgtcaaagatcagatggttgtagatgtgtgacattacttctgaggcctctgttctgttccattgatctatatatctgttttggtaccagtaccatgctgttttggttactgtagccttatagcatagtttgaagtcagatagtgtgatgcctcaagctttgttctttttgcttaggattgtctggctatacgggctgttcttttcttctcttttggttccgttagaaatttaaagtagtttttttccaattctgtgaagaaagtcaatggtagcttgatgggtatagcactgaatctataaattactttgggcagtatgaccattttcgtcatattgtttcttcctatccatgagaaggactcctccctaaatcattttatgaggccagcatcatcttgataccaaaacctggcagagacacaataaagaaagaaaatttcaggccaatatccctgatgaacatcaatgcaaacatcctcaataaaatactggtaaactgaatccagcagcacatcaaaaagtatatccagcacgatcaagtcggcttcatccctgggatgcaaggttggttcaacatactcaaatcaataaatgtaatccatcacataaacagaaccaatgaaaaagtcacatgattatctcagatgcagaaaatgccttcgacaaaattcaacatcccttcatgctaaaaactctcaataacatatctcaaaatagtaagagctatttatgacaaacccacagccaatatcatactgaaggggcaaaagctggaagcattccctttgaaaaccggcacaagacaaggatgccctctctcaccacacctattcaacgtagtattggaagttctggccagggcaatcaggcaagagaaagaaagggcattcaaataggaaagaggaagtcaaattgcctcagttttcagatgacatgattgtatatttagaaaatgccatcatctcagccccaaatcttctttttttttttttttttgagttggagtcttgctctgtaaccaaggctggagtgcagtggcgcgatctcggctcactgcagcctccactcctgggttcatgccattctcctgcctcagcctcctgagtagctgggactacaggcacccaccaccacgcccggctaattttttttgtatttttagtagagacagggtttcactgtgttagccaggatggtctctatctcctgacctcatgatccgcctgactcggcctcccaaagtgctgggattacaggagtgagccaccgcgcccggccttcagccccaaatcttcataagctgataagcaacttcagcaaagtctcaggatacaaaatcaatgtgcaaaaatcacaagcatttctatacaccagtaatagacaaacaaagagccaaatcatgagtgaactcccattcacaatttctacaaagggaataaaatatctgggaatccaacttatgagggatgtgaaagacctcttcatggagaactacaaaccactgctcaaggaaatcagagaggacacaaacaaatggagttctgttttcattagatgtgtcttgggaacgactgtatcacatagattcagaatttcttgagctgggagggttttagaaactatgaggtacagaacaatttggtaaagaggtttgtaagctgcttcaacttaagccacatgggaatcttgtaatttggtacatttcagacagagactaagactcagatatcttctttttttttgagatgggatatatttaaataaatattttatatttaaaatacataatttaaataattcccaatgaaaaataccaaaaaaaaaaaaaaaaagtgataaacagggctggctgcatagacaggatattccactcccctgagggaatatccatcaagtagaccaaagcaatcatttctaggggggagtaaaaattaagccaaaggaagtgccacaaaatttaatacctgttggtttgtgtaaatacattttttaaatgtgcatttattttaaatataaaaaaatttattatgacaaaccgtaaattcatacatcagattttcacaaaaaatatactcattgatatttataaaatatactcaatattttataaaagcaatcatatcattaggcctcttttcatgcctttaatattgtgttttgtaatagattaggtagggtattatataattcaaagaacgcattcgctcaaggcctttgggaagttgatatctagctttccaagaattcacactagaagactggtccattttattgattcttgctgatagatgaaaacctgatttgctgtacaacctaattctttgagtcccatgttgggacatatttagtacatatttgctttgctttgtgacaaccaatatgtctatataagaatattctaaaaattattttattcaatctgtgaatattatcaaataaaactaggattgctttagaaagttttgaacatatctgttttaccaaacttttattccaaagtttaaaaggcaacagaatgcataaaaaacgatgaataacattaccgttccattatatctccatcttttttaaagctatctctaaggtattagttgtgggtatagggatatccttagagaaagaagcttagaggaaagagagtgaacttagctgtcagaatcgatctatgaaggtgttttctgaaatgacaaattcaaactggcttgaataatatgtaatttattatttgtgtagcaagagtccacatgaaaggtgggcttcagtgttggtagtttcattgattcaacaatgtaggcaaggacttagaccatttcaatctctgtgttctgtgatctacagtgtcaacttcattttggcttctcttattgccataagatgacttcaaatacactttagagctatcctagcctttgattaaatcccatggtagtgtgagactgcctattcctcttacaaggaataaacatttgttgagagaaaattttccatgagccccttgtgtttttgtatatcttctgagcaaagacgttaacagttttgctattactgttgaagactttttttttttttttttgagacggagtctctctctgttgccaggctggagtgcagtggtgcgatctcagctcactgcaacctccacctcccaggttcaagtgattctcctgcctcagcctcctgaatagctggaactacaggcatgcaccaccacacccggctaatttttgtatttttagtagagacggggtttcaccatgttggccaggatggtctcgatctcctgaccttgtgatccacccacctcggcctcccaaagtgtgggattacaggcatgagccaccgcatccggccgcagactattttttaatgctgtttgtatagcagacattcttgaaggatggagattctgcccctctctgagaaaagggctgatatgttttctgacaagggcaacaaagatgatgtctcccattgcagacattggtagtggtccccctctaggagtgggtatttcctaagttcagcatttctctgctgtgacacagacctgctgtgtatgtggcattcaccttagcccaatcccacatcaccctgtgcaatttgggatagggggaaactggtgtgaagctcatgccctctgatgtattgtgagtgttgtgagtaatgaattcttttgtctctgaaccaggggtctctatgtcttctggcagaaaaaataaataaagaggcttttattttgaaagtagagtaaaatcatcctttttgataaatatatttataactggattaatagtaatgcttaagtgtaatttgaaatgatcagtttctgagcctttttagtaaatattaaaaatatctacttatacaagacatgactttccacagttcttatcagtttctaaaaacatttctagtaagtctcttttcccatgaaattagtcaacattggtgtcttagcccattttgtgctgctataacagagtgctgtagagtggataatttataaaaaacagaaattcatttcctcacaattcaagatcgagggattggcattgttgaagaatggcaaaaggtagaaggacaagggggctggggtgagagagagagtgtgttttaaagggagccgaactgccccttttaaagtgaagcgagtcctgcgataatggcattaatccattcattccacccttgtggcctaatcacctcatatttgacttcacttcccaacactgttgcattgggaattaagtttccaatacatacagttgggcagacacattcaaaccatagcaggtgagttccatgtttttcctaaaccatagcagttaagtcagcaataagaatcaaccatagttagaagaggcagccctgtgccttgagctgaggccaattcttagactacagtgctattactcgttatatagaggaagagtggaattaaatttggagactcaaataaaatatcaggcaaaaattctatacccaaataatgatggcatctagaaagacttttgtacatgaaaaacatagaggttaaagcttttttactatgacagtgatatagatggtggggccaaactccaaaaaggatattatttccttatgtattttagccaaagtcagcagcacctgttttaaggaaatacgctaaatgatcgttacaccacaactctcaatcttggtagcataagatctgcaacacatacatcacaggttgtttgtatatcttctttcaggtaattcctaatttatttttataatttgtccactgacagaagaaacaataaaagttctcttcaattattagaattgaaaagaggcagataaatcatcttttttgataaatcatctttataactggatttgtagtaattcttaagtataatttgagatgatcagtttttgtgcctttttagtaaatattaaaaatgtgtacaaaaagtgaatttcacaattttagtatgttagctaatttctaagtcataccctccatttctgtttttcactaacaactgactttagtttaacaccagaggattttcttgagaatgttgagaattaatgtgacacttgacatataaatttagtatttcagtaaagtaatatagcattgtaaaaagcggttaacatgttggtcacagaattacagaaatatctcaactatgctaatgcaaaataggcgcaacaaaaattgcaatttctcagaaggaaggaataaaatactttttatgaatctttaaaggatgaaatgaagatataaaactatcaatttgttaatattgtcttcttttttgaatggcataagatgttttaagtgaaagcctattagagaattaaaattactgtgtgatacaaaggcaagagtagaatttattgaaaaattttgtgactactgaaaattggtacacttctccagagaagatacatgtatgaccaacaagattgtgaaaagatgctcaacatattggtccttaaagaaatatgagtcaaaatcatgatgatatactacttgacagcccctagcatgaatataatttttaaatgtaggaaacaagtgttgtcaggaatgtggagaaatcgctgttggggctgtgaaatgtttcagccactgtagagaaaagtttagcagttctccaagatggtaaacacagaattaccatatggcccaggaatttccctttaaagtatactagaaagaataaaaaattggaaatcaaacaactatttgtgcacctgcactaatcacaatagtcaaagagtggaagcagctcaatgtctaccatcagataaatggataaacaaattgtgatatatacagacaatggtatattattcaaccatagaaagaaatgaagtacagatacatgctacaatgtgtatgtatcatcctggaggatgaacctcgaggacattttgctaggtcatagaaactaaacacaaaaggtcatatactatatcatttcatttatatgaaatatgaacaataggtagatccacagacacagaataaaggtaggtggctgccggtggctagggggttaaaagaatatggagtaactgattaatgtgtatacgtttccttttggggtgaagaaaatgttttggaaatagagatgatgattgtacaacattgaaaatacactaaaagccactgagttccttactttaaaatggttacgttacatgaattttgcctcaatcaaaaataaataaagttcgatatttgtttttttaaaattggtacattgcccactaagtagaatattcactagaatatgcatgtaacttaaagtttattttaacctaaatattagtcacaagtcatatatagatgaatatcataattttatcatgtaaaatgcctagttgctgattacaaaattgtaaagtttaatttttaatttacaaccttttatattaagcaaaacataacagtttcatgatatttatatatttctatttttctatcatggtaatgaaattttaaaaaaatccagtgtggaacataagacttcagcatctatcagggtaaatgtttatttgttagtaaagatgctttgggagtctatttttaaatgattggacatatgttttcaaatacattaaaacctcattctccaggaccacctagtctattcaactgaagagctattgcttaaagccagctttccgtaaaaattaaatatttaattatctaactaccctctcgagacaatcaaaatagctcaaattcattagtgttcattacagtttttttaaatacatgccaactatatttcaaaagacttcattttttgacttaaggacattcagagttgctatcaaaagtttgcagtgtttgtcccccttaacctttgcagtgacaatttcaaatgaagaaaataacctctatctgtcttattcaggcacatttttaggggctaaaagttcatttttgacatattcattcactaaggataatggatatctctgttggcctttgataattatggttatgtggccttaatagggataatgaattatttaaaactattatgctgtttcttaaaatttaggagacaaatatcacttccaagtactcttctgagtgttgaaggttatgtttgtcctgtttgggttacttacattagtggaatgttttcaatgtaaaactcattctttattaccaccaagacacaatgtcaagtacttttccttcactgctatttgttagaacatattatctgattctgtattttcttcctcatatacaaagtcattacagaggtgggctggtggcttaggccagttcatcattcagaaaataaagctgttttttctacataatcattgagataagtagtgactgctgaggctgatggtatcttaaatcattgatcattcgttggggaagtagttgtatatgcctattatgtgtcagaaattgatgatataaagaacaggtttgaccataacgcatacaaattctattcaacataaagtctaatgttcacaaattgtttcatgctctccaagagaagaagaaagttctcaagttccctaatgttgtccaaaatgaaatacaaaagggaaaatatttgcaaaaggcaggttcactaatatttgtacatctgtacagaaattcccaccatgaaaagcttccgtacacatatttgagcatttatttgttcagtgagtatatgttgagcaactaccaggccacaggcacagtactaaacagtggggacacagtggagaacaaaagtgacacggtgtctgctctcttggatgttcaggtgaaatgaggagagagtcatggggacgccaactgcaccgaatattgctaacagaaaacataaataaatataaaatgcttgaaatggtctgaaggcaaattacagggtgtgctaaggcagtgttttaggagatctaatttagattacactatctgggaagccatctctgagcaaatgatagtgaggcagtcgccaaagggtaaagaggactctcctgggtgaagggtggtgggtggagcatttcccataggcagtgtgaggagcagcagcaggaagctctgctgagggaagagtgtagggactcagagatcctcctgaggaaatgacagaaagcaactttgctagagtgtagtgagcaacacaggacagtgtacaagtggtgcaaggaactgagcaagttagaaagtaccaggcctctgaaaagtgcattttaatatttatggctatatccttaaatctcagcgaaagattggcatacatgcacatattccagttagcagtattatcaccaaaagcacacatcaacatccttcttgttaactgtgttttcaggatggctgagggtttcctcatttaaaaatacttcataatattatccattttgggaaaaaaatgtatacacttcaccatatgaaaggctataatatgataaaatctaaccttttatgaatgccttagagataagggaggcagcactccacagatattcctgaattaaatttaagtcagagatcaaccaataattacctaaaatatctgtatagttctactgaaatagaatgaataataagcactaattctacaaagtaataatttaatattacatagaccccatggaaaactaaaaaacactgtgaatctataaggccaattccttgtattttgttaagtcccttttgtattctcagaaaccctggctactcctggtttgtagttctgtaacaaaatgaagactttcagtttgggggagtatttctattcttagaaataagtggtgattacaaacagtgatggggttaccttcattgttcaaggagactgaagggtaaaatgttaaaaagaatacctgctgaaagctttgcagactaatttattatttttaaattctttcattagtcacagacatgagcatattatttacacttgaataaacctgcccttttaaaattgagaagggaattaaattcaaaggactttcttatataaaacaaaaatttgctttctgcaaaattatttttatccatcttaagattctatgcagtttgtctgtttcctaatttgaaattcagactattacaatgataataataatgatgataataataataataatacctcttagatgtactaacttgaggcagatggaaatagaaaatccaagctgctattcagcgtataatcactatgcaaatattccagcagcttgtacgatttttcaaactattatctcaagagcaacaaaccattatactgaaaagttgcaaaagacagcacagtaaatagatgttatgcatgtagagtttgggacaatttatagtcaattcaacaatgttaaaataaatctagtatttttaaaagaatacaagtaagaaaagggaggcttgaagattatgtttgaaaacatttccctccctgctatctctctttctttgtcttccccattatagccacatttctttaaaaaataaaacaaaaacagattaaaaaggaatatttacttcctcacatcttattcttttaggacctattgaagctcatctattaatttatttaaaaaatattaactgaaaccctgtaatttatggtgtgctgaagattgaatggcaagtcaagtcatatattgtacttgttgccatgaaactccatctacttgggtcagtggataccaaatgtgcattacaagggagagtgtgtatgttttcaactatagtagagggatttgaattatgaggagtttaagatgtcatcgatgaagaggtacactgagaaaaaaaagtgtgtaagttaacccagcagagagaagaggaaggtgcattttaaaaagagaccaatggcagaagtaaaccgagagagtacacaggaaaaaatgggaatagctaagcctgagaggcatggagggagagaggtctatagaaggatattagaaccaggccatatgggcctcaaaggccaggttaataagttttgttttattccccaaagcaacaaaaagccatgtttatttagttttaaggaagtggagagcatgatcagatttgcattttgaagcagtaactttgtccacactgtgacgaaggaaaatttgcagtgcagggctgcagagcctgtcactgtactgcaactgttcttgtctagggagttgactacttctctttaccaactaaacccaaaggaaagattttattctcaatcttactggaacacatttgtcttcctcgtgattttttcctaggtctgcttccattgtcatattagccaccctctcaaagatttcacttacctggtggcttcatctctccctcccaccctatgtgttgatgactttgaaatatgcaactcagaagagatgtcttctccaggcacttcaaatgcagtatgttcaaaactgaactgtgtgattgccctttaatttcaatgctctttcagctttgtttacctatgaatgacttctttgttcacataaactagggttattcttgaaaccactatggtctcacttactgaatcaaacacctatgtcatccatttctgaccgtaattctctctcaaagtccgttgctgcccttggtctccataggtaactgttttggtttatcatcacctttctgttcacataattaaatatatcctattctctacaactgccctccctggaaactgttctgcaaatggtagccatagggatctatgtagaacaaggtggtcattagctctttgctgggtaaagcattagacaacttcccttgtcataaagcccaaacccctcagctactcttaaggatcctcatgacctcttctctcatatttcttgccacctgaaatctacactttggattcacttcagtcggactgaaatgcatgacttaatgtccccaaatatatggtactctttcaaatcttcacacagactttcaaattttggtacagactattctcattgtttattacactcttctaaaacttccctcttgagagggctaaactcaattttcaggattctatatagatttcattcccacttctgcccccagaaattaggttttcctaatgcttgaaattgcgatttgcctcagcatggaattcattttttcacttatatttaagtgaagtcagaggtcataagccatagactattgagactgtctatattattcagcattttatcacttctgcttttcacaaatacctagcacatacaggtatgcatgaaatatttacatgcataataaataattgatgttacctatttctgatttttaaaaatgtattattaatataattttaaatgtttgtttattatttctaagtatagagctgaacaattaataagagttcataaaatgcttattaaattgaaaatatttgcaaatttgaaagtggtgtaataatattaattgtaattactaaagaagctatggtaaatgttatttatgtcatctataaataacttattttataaacttataattcctctgagttatcataacttcttaatgaagtgataaaagagtttcaagaattaaactcagaaaaactgtatccaatggtttcgatatgcaaagactttgacagacaatgtaaaaaaattttaaaggcctgaagtcaattaccaacttcaaattataaaagttttaagaagaaattcaggagggacccagattgccaactagaagcagcatcagtcagtggctcccactgagaagaacgaaaacggcaagtgaatcctgcaccttcagctgagatatccaggttctctcatggggactgactaggcagtcggagtgacccacagagagcaaggaaaagcagggtagagcaacagcccaccttggagctgcacggggcaaagggagctgccacccccagccaagggaggtagtgagtgattgtgctaccccacctaggaaaccatactgttttcatggatctgtgcaactcgcccatcaggagatccatttgtgagctcatgccaccagggccttgggttccaagcacagagctgtgcagatgcttggtggctgctcaggttgcaaccagcggcagcaggctggacactgcttaagatgaacaagttggggggaaggggtgcctgcaaccactgtggctccagtctgccattttcccttgctggtgcccaggatatgcacagtacagtggctgtggcagatagtggccagcctgcttctttaggtgggaccctgatccatttctcctcagcaggtagggcttccctgtgggaatttcagaaactccagccaggggtttatggatagaactctgatctccctggaatgaagcacctgggtggaggggcagtggcagtctctgcagttcagccaaattagtctttcttgcatgctggctctgaaaagtccaggcagtccagatgagagggactacccccagcacagtgcatcctctctgccaatgggcagccagagtgcttcattaagtgagtccctgatcccttgcctcctgactgggtgagaccccccaccgacaggggtcactaggcaccctatacaggagcattcctgccagcatcaggtcggtgcccctctgggatggagctcccagaagaagtagcaggcagctatctttgctgtttttcagcattcactggtgatgcctccaggtgcaggaggaacccaggagaatggggtctggagtggaaccccagcaaaccacagcagcctggcaaagaagggccttactgttaaaagaaaaacaaaccaaaagcaacaacaacaacaacaacatcaacaaaaaataccccacaaaaacccacccaaaggtcagcagcctcaaagattgaaggtagataagtggtgaatatgagaaataattggccgggcgtggtggctcatgcctgtaatcccagcactttgggaggccgaggcgggtggatcatgaggtcaggagatctagaccatcctggctaacatggtgaaaccccgtctctactaaaaatacaaaaaaattagctgggcgtggtggcaggtgcctgtagtcccagctacttgggaggctgaggcaggagaatggcgtgaacccgggaggcggaacttgcagtgagctgagatcgggccactcactccagcctgggtgacagagcaaactccatctcaaaaaaagaaaagaaaagagaaataatcaacaaaaaaatgccaaaaactcaaaaagccagagtgcctcttctccaaatgatcgcaatacctgtccaccaagggcacaaaactggacagaagctgagatggatgaattgacagaagtaggcttcagaaggtgggtagtaacaaacttctttgagctacaggagtatgttctgacccaaagcaaagaagctaagaaccatgataaaacattacaggagctgttaaccagaataaccagtttagagaggaacataaatgacctgatggagctgaaaaacacgacatgagaacttcacagtgcaaccacaagtatcaatagctgaatagaccaaatgtaggaaagaatctcagagcttgaagactatcttgctgaaataagactagcagacaaaatcggtgagaaccatggattatataaaaagactgaaccaacaacaaattggagaacttgaaagagacgggtagaacagaaccaagttggaaaacaaacttcacgataccatccaggcgaattccctcacctagcataacaggacaacattcaaattcaggaagtccagagaagctcagtaggataatccataagaagatcaaccacaaggcacataaactccaaggttgaaatgaaggaaaaaaaatgttaagggtaaccagagagaaaggtgaggtcgcctataaagcgaagcccatcagactaacagtggacatctcagtaggaccctagaagccagaagagattggggaactaacattcaacattcttaaagaaaagattttccagcccagaatttcatatctggccaaactaagcttcataagtgaaacagaaataaaacccttttcagacaagcaaatgctgaaggaattagtcactgccaggcctgcctttcaagagctcctgaaggaagcactgaatatggaaaggaaaaactgttactagccactacaaaaagacactgaagtacacacaccaatgacactatgaagcaactacattaataagtctgcaaaatagccagctagtatcatgatgacaggatcaaatttatgcataataatattaaccttaaatgaaaatgcactaaataccccaattaaaaagacacagaatggcaagctggataaagagtcaagacccattggcatgctgtagttaagagacccatctcacgtgccaagacatacataagctcaaaattaaaggagggaggaaaatttaccaagcaaatggaaagccaaaaaagcatgggctgcaatcctaattactgacaaaacagccttaaattaacaaagatgaaaaaaagacaaaggcattacataatagtaaatggttcaattcaacaaaaagaactatactaaatatacatgcacccaatacaggagcacccagattcataaaacaaattcttagagacctacaaagagacttagactcccacaggataatagtgggatattttaacaccctactgtcaatattagatcactgagacagaatatcaacaaatatattcaggacttgaactcagctctggatcaaatagacctgatagatatctacagaactctccacccaaaaacagcagaatataaattcttcttggtaccacttggcatttattctaaaattggccacataactggaagtaaaacactcctccttagcaaatgcaaaagaactgaaagcatgacaagcagtcaagcagaacaaagcacaatcaaattaaaactcaagattaagaaactcactgagaaccacccaactacatggaaactgagcaacctgctcctgaatgactcttgggtgaataatgaaattaaggcagaaatcaagaagttatttgaaactaattagaacaaagaaacaacataccagaatctctgagatgcagctaaagcagtgttaagaggaaaatttatagcactaaatacccacatcaaaaatctagaaagatctcaaattgatattgtaacatgacaactgaaagagctagagaaccaagagcaaaccaaccccaaaactagcagaagacaagaaataactaagatcagagcagaactgaaggaaacagagacacaaaaaacctttcaaaaaaataaatgaatccaggagctgggtttttttttttttttttaaattaataaaatagaccactagctagactagtaaagaaaaaaaaaagagagaataactgaatagacacaataaaatgtgataaaggggatatcaccactgaccccacagaaatacaaacaacatacagagaatactataaacaccactatgcaaataaactacaaaatctggaagaaatggttaaattcctgaacacatacatcctcccaagactgaaatacgaagaaggtgaatccgtgaatagaccaataatgaattctgaaattgaggctgtaacaaatagccaccaaccaaaaaaatcccaggaccagatggatttacagctgaattctaccagaggtacaaagaagagctggtaccatttcttctgaagctattgcaaataattgattaggagggactcctccctaattcattttatggggccaaattcatcctgctaccaaaacctggcagagatacaacaaaaaaagaaaacttcaggccaatatccctgctgaacattgatgcaaaaatccttaataaagtactgtcaaactgaatccagtagcacattaaaaagcttatccaccacgatcaagtcagcttcatcctcaatgcaaggctggttcaacttatacaaatcaataaatgtaagttatcacacaaacagaacgaaagacaaaaccacatcattatctcaatagatgcagaaaaagccttcaataaaattcaccatctctttatattaaaaattctcaataaactaggtattgaaggaacatacctcaaaataataagagccatttatgacaaaaccacagccaatatactgaatgaacaaaagctggaagcattccctttgaaaactggcagatttcagaatgccctctctcaccactcctattcaacatagtattggaacttcccgccaggggaatcaggcaagagaaagaagtaaaaggcattcatataggaagactgtaagcaaattgtctttgtttgcatatgacatgattctatatctagaaaatcccatcatctcagcccaaaagcttcttaagctgataagcaacttcatcaaagtcttaggatacaaaatcaatgtgcaaaactcacaagcattcctatacacccagaaccaacaagcagagacccaaatcatgaatgaactttcatgtacaattgctacaaaaagaataaaatacctaagaatgcatctaacaagggaagtgaaatacctcttcaagaagaactacaaacgactgctcaaagaaatcagagaagacaaaaacaaatggaaaggtattccatgcttccatggataagaaggatcaataccatgaaaatgaccatactgcccaaagtaattcatagattcaatgctattcccattaaactaccattgacattcttcacagaattagaaaaacctattttaaaattcatatcaaaccaaaaaagaatccatatagccagaaaatcctaagcaaaaagaacaaaagtggaggcctcatgctacctaacttcaaactatactacaaagctagtaaccaaaacagcatggtactggtacaaaaatagacacatagaccagtggaacagaatagagcagtcagaaataagattgcacatctacacacatctaatcttctacaaacctgacaaaaacaagcaatgaggaaaagtttctctatttattaaatggttttgggagaactggttagccatatgtagaaaattgaaactgaaagccttccttacaccttataaaaaaattaactcaagatgaattaaagactcaaatataaaacccaaaactaggccggacgcggtggctcacacctgtaatcccagcactttggaaggccagagcgggcagatcacgaggttaagagatcgagaccatcctggctaacacggtgaaaccccgtctctactaaaaatacaaaaaaaattagctaggcatggttgtgggcgcctgtagtcccagctactcgggaggctgaggcaggagaatggcgtgaacccaggaggtggagcttgcagtgagccaagattgtgccactgcactccagcctgagcaacagagtgagactctgtcaaaaaaacaaacaaacaaaacccccaaaactataaaatccttagaaaatttaggcaacgccattcaggatataggcacaggtaaagattttgtcatgaaaatgtcaaaagcaattgcagcaaaagcaaaaattgacaaatgggatctaattaaactaaagatctgcacatcaaaaaaaaaaataaaacaaaaatcctatcatcagcgcaaacagaaaacctacataatgggagaaaattttgcaatctatttatctgacaaaggtctaatgtcctgaatcttcaaggaaattaaacaaatttacaagaaaaaaaaaagaccccattaaaaagtgggcaaaaggtatgaacagaaacttctcaaaagaagacatttatgtggccaacaaacatgaaaaaaagctcaagatccctgatgattaaagaaatgcaaatcaaaaccaaaatgagataccaccagtggtttccagtgccctcacaaaaaggtcaaacaacctaaacatatactttatcacttagcaggaaaattttgagagttaaaagtgttgccagtaagtaattatctggggacaagaggtgctatcaataattatgataggactgttctggtcaaccaagacaacatataatccttcttcttagagatgctttaaaatccagtgcctacttgcctctcccagcatcaaacccaaaccacaatgtgctaatttactaacgtagtgcatgtactagccagccataatgtactactataattcccaaaatgtatttttttttaaattttggctatttagtacttcacttctctctaatgatagccaactcctaatcatctttcagttccttagatatcacttcctccaggaaacccctgcttttactactgttggcattctaccctttagtacactgactacactgtgctgtaaccaaagtttgtttctatgcatgttaccacctgtgacccctgttggattccttgagagcagactgtggtagccaccgttttatcctccactcctgaaaaaagaggtcccatagagtaagcatttcatcagtgtttgttgagcaaataaacaaatctattttcttcttgtcacttctctttgtgttcttcattattaaatgggtaaaataagaattgtgcctatttaataggatttttgtggaatttttttagtacaatatacaaaaaatgcttagtgattatctgacaaaaagaccatctcagtaaattttagcagttattattcctcgtgcttagatcaaatatataacatgatatttttgcaaattattttcgtgatcattttcagtcagatctattttatctcacaaattttgtgcttctgttttagataattctctcaccatttgacttgtaattagtgtaaaataatctgtctttcccagtaagttttgagttctttgataacagactctcatctcattcactgtggatttccagtgacagacacaacacaggcattgaatcaaacatcagtggaatatcttatgtttaaagaaaattgaagactgaagacatagaattgtggggttcctcattgcaagataaagttgacaatgactttttttaaactcctggtaaatagatcatatttactttgaaagattttttgttgttgttgttgtttgtttgtttgcttgcttgcttgttttaaatagtgggaaagtcctaaggcattcaaaagtaaaatagtattttagattgttgacatactctagaaagacttttccttcaatttctaatgcaggcaactagccatatacctcatttgaattattatttccaaataattcagatgacagtagatttggaggaatctaagagcccttaaaaaacatcattccaaattctttaattttagaaatgaggaattacacatatagagaagctaagtaactttgaaattctaattggcaataaaaaatctggggaaatgcaatcactagctatttatcccaatagttaatgtcctcaaaatcatcagtaatttagatgaaactgtcagttcaatgtattctagatgcagtataggtttaatggaaagtctgcttgaattatatcccattttattgatgtttcactaataagtgttccaatggacataacaaattcaccctcaaacttgaaatttttcccttgttaaaatactccagtttaattatgtttaatttaaagttggagttttaggactgctgctcatggctagacattgattttacctgcattaaggaaattcgattaccttgaatcatttatatatatttgtaaatcacgaacggtgcttttctgatgtttgggactaattatttccatgaatacaaacgtcagcaatatgaaaagcaagttgtggaatgaaacaaacaagtggcaccagaaaatattgcctgcataatccattgtgttctttataaccaaatgccatttgaaaccgtgcactgatgcagatggcaagatagaatttagactttatgtagtagataatataattttattttgcttcattttatttctgaatactatatctgaataaacaagcacattagtaaatgtgtgacaacatctaccttatttatgtttttgtttagccagtgaaccataggcagtaagtgattgtccttaacttttgttttttggttagaggagaataacataagtagtaacacgtgaattgttacagggtgagttatgctttgcaaaatacattcttaatcagataatttggtaattataacacagactccaaagtgttgcaaaaataaactatcactttaaaaagagcttaatgcaatgctgggtacttactcatgaactgataatttaacaaaatttaccaatggaaagcaagctttattattgttagtaaatagtatgctctatgaaagagaagctgaaaagtgctcactttatctcaatacattatttcccttaaaaacgatacataaggaaaaaactctttgttaaacactgaaacaactggaaccaaaacaagttttatgaaattaagtggacagaattgttccctaatgctttagttgggagttgtttttttttttggtttgtttgttattgtttgttttgttttgttgttttgagacggggtcttgctctgtccccaggctggagttcagtggcacgatcttggctcactgcaacctccgcctctgggattcaagcaattcccctgcctcggcctcccaagttgctgggactacaggtgcacgccaccacgcctggctaattttttgtattttagtagagatggggtttcatcatgttggccaggatggtcttgatctcctgacctcatgatctgcccacctcagccttccaaagtgctgggattacaggcatgagccacggcaccgggactagttttttttttttgttttttgtttttgtttttaataagaatagttggttggcactcgtaaaggtctctattggtattgttgttattaaacgaaacacagataaactgtttaattttaagatttgttaaaatatttttgtagtacttccctagttgctataggagctgaaagatagaatatttgttgtggaatttgcaaactagttgaggcaataaaatagtgcacataaaatggcaattacagcaaaagaaaactatgacattaagtgccttaattgtgctggtaattatcaaaaggcaatgataatcagccacaatgtccaactggcattctgtcagccagcactctcctgcagaaacagaggggtatggtaggttctcacttgatgccaattcaacctaggctagaaatgacaccaagaaatgggcggggaaatagttgcagaagtgatgagactagctctgcttcttgatgccttgccaccctttccagaattcaaaagcacgttaaccatcatatggaagaacaccttaatttagttcaaaccatgagggaaaagagtgaggcattagtgaaaaatatcatctcatgtaaatgtagatatcttgcttacttacttaaagaggttgtgcttcctatactcacagttcctcaaagcataattgtaacgagactggtggtttaaaatttgccagtttctttgtaattgcatggactttgctgagtctctaggtatgatgagcacagtaatttgaaactgtaacctgagattaaggcaaatgatgctttctaatagaaaaagctgaaactagtgtgatgagcagtaatgtctttaaaattaaattttgtattgggtaagtaaataaataaataaaagaatgaaaaataggaatatctcaatatgtttattattccttaagtttttggatagtgtaatattagtgttgaaataattatttcatatacgatcaaatatgtgtgtatatagaaacacaaatattgacatacatacttacatataggtagatgagatggatatatagataattatattgggtagaaagattaaaaaatagcttcatgtggggcattatccccaaaataagtatctaggtaatgtacttgtgaaatcagtgtggtctgtgattaccatctagtggcagtgtccttgaattgcaaatactcagtgccagtaggaaacccaaaggggattatttggcccattcaacccattttcttgatgtaatgaattattatgaaacatcagcaaccacacacctactatacaatatataatagagttatatattgtaaacacattttcacaaaatggatgatttctacatgaaagttatttaaataaggctaattgaaaaacattttaattgagttttgatagcaaaatcaaaattaggcttgagaggaaaacaattgaaaaaaattgagaggaaaacaatatgtttaagttgaatttgattacagatagtatagtttacaaataatagagtttaggaactaaaagtcctgtgtatactttgacaatggagttggtcaatattaaaatgtgtacatttggctaaataaaaataggcagtgtttgtgttgagatttgaagttcagactaaacagcactgtaagggtaaaacattttttagcatgatagaatgaggacataaaaatgtgaccatatagctatattggttatgttgttatgggagaagataaattaggaattgtttgcaataatttataaggtatgagcactggtatttcagtaattgttgagaaaatgcaaagaaagggaagaatatgtaagctttgtcaagaaagaggtaaaaatacttgtcaaatttggcagcggaaacttaaaaactgaaggtgtctttaaggttttcagtatgaagatctcagaaacgatggcggtattttaaaaagtatttgaaaaattaaaattaaatattacagacctttgttatagggtatcaatctcataaaagatgtacccatttctaaggaatttttctatagtatgtcattcaatccttccaactcttcctccatttttaacctgggaggcaaggcaggaatcaggttcaaatatattacatcattttcccaagactttattgctaatatgtggcttcatttgacctccagacccatctactctaaaattcatgatattttccttctctatgaaactgattgtttgttgtttggcatcttgacagatttttttttataatttatttttttcgaggtggagttttgctcttgttgcccaggctggagtgcaatggcacagtcttggctcaccacaacctctgcctcctgggttaaagtgattctcctgcctcagtctcccgagtagctgggattacaggcatgtgtcaccatgcctggctaattttgtatttttagtagagacggtgtttctccatgttggtcaggcaggtctcgaactaacgacctcaggtgatctgcccacctcaacctcccaaagtgctaggattacaggcatgagccactgcacccggccaacagaatttttttaactaagttaatgtgaagattctacaatatatttatctatcaattaaaaattatgtgagaccttatattactagaattcagaaattgtgaagtttactaggttgtttgctatatataatgaaagatgtttgtactaaaaatatacctaaaaaaatcaaaataagagaataccaaaatacatttatatatgatagtcctttttttaaaactgcgtcaatgtaataactgaaaggtagtttgctcaagtttgcagtgcattgtgacagtgtaagtcttttctatcattaaagattcagtatgaacacattgatgcaacctgtctgatactgaaagaaggggcacatggcagtctgagtgcagagagaacacagtggtctccttcaatcctcacattatcactgtttctgattgtttatgtttattcataggtaataatgtcttttatctcaattataattttaatttggagctaagataggtaaactccaaaacatatttttaataatattgtgtattctataattattaagggtgtttcctttcattttcaaaagtgtcttagtttgcatgataaattatattgtcaccttagaccaggggttcttggacagagacatgacaatctggtaaaatttatgaacccttttgagaataatgttttgtgattacaaagagaagaaaacagaatagagttatcaaactattttaaaaagtcaatttgtgaagcagtagtcattgtgctcctttgccaactcattaaataacaagatctagggatagttaataactatcttaatttaaagaagacatgaactaaacaatgtttctatacagctgtatcaactgtaatgtgagatcacaatatttacaatttctattgatgaagaagtcccaggtactactaattctactgtagcttatggtctgcatttagtctaaataaaatgttaattttcagttctctaaaagttatgatttattcttttcttaatccaaatgtgcatattcagctaattaagaacccctagatacactacattggtgctttatatgttttctccaacactagaatttgagctttttaatcacacacattatattcatctttgcgcctttggtaacaaatgtaaaggataaaacatctgaaaagtttgataaatggataaatagataccacaaacaataaaatcagttaaaaagcaaggatctgcaaaatttttcaggaaaaattccataatagcaaatttagtatagaaaagtctccaaatgaaagcctgaactagtggtgtgagatgtaataacatggacacaaagatgaactttacatagactgggacttgtgctagagtccacttttttgggagagatatgaccttttagtgtcctgagcgacttaaaagctgacagaggccaatccggaccacacagtctttgaaatgacatcttggtaatctacagtattattagatccaggatattaaaagctaggtcaaaggacagttctgacaaagaaaagactctcatccttttgttccataatcccttcctatttccagtcccattcttacatgcagaagtacactctgaagagcataggcagtgttatcagagaagctactgcgatgtttgttctttgcctggaagtctttgttccataatctcttcctatttccagtcccattcttacatgcagaagttccctctgaagtgcacaggcaattttatcagaaaagttaccataatgtttgttctttacttggaaatctttgttccggagatctcatcacatagtttttcctttctgagctctcagcagtaagttctatgccttgttgttttggcatctccatcaagtctcccatcaatggattgaaaatataaactaggtgaaaaatgcattctttgttttcccactacctactcagaggtctacctggtgtttgtagagcagggaaagaatatgtacatatgccatgtatttcatatttatataaatatatatatgtttagctgtatgtatgtatgtgtatctggagatctaaacaaagagaataaaatgaactaatttctagtgagaaaacatttaaacatcctccgctcttccagctgggactcagtagaagtgcattctaattctgctggacaaatccttctaaatactctaatccccataagaatagttgtatttattcagctcatcaacaatgatgatctgagaaaaaaattttccaaattatgtggatacagggagatagtaggagatcatgaaacataaagaaaaagggacacaggaaaagacaagaacaggtgctccccagatgctcatggtgtttaatgagaaagcatattttgttataatgaatgttcttggcagtccttgatgagtgattgtatctttttaaaataactgcattagtaatttgtactgacactcttcatgccagtaagataagctgtttcagataatgataagtgatacaaagaaaataaaacagtgatgcaatagatagtgacagagggcacctactttggagaagattgttgtaggcatttttgagtaagtgccattgaagtgagacctgaatgatgagaaagagaccgtcatgtacgcagcaggggaaagaacattctagacagaggagagaacagatgcaaagtccctgagtctgggaacaaaattttagaacagaatgcatatcagagcagatgaaacgtgttttttgttttgttttgttttgtttttctgttttttttgtttgtttttttttttttttttgagacggagtctcactctgtcgcccaggctggagtgcagtggtgtgatctccactcactgcaagctccgcctctcgggttcaggctattctcgtgcctcagcctcccgagtagctgggactacaggcacccaccaccacgcccggctagttttttgtatttttagtagaggcggggtttcaccatgttagccaggatgatctcaatctcctgacctcgtgatccgccccccttggcctcccaaagtgctgggattacaggccgccgtgcctggccgaaacgtgttttaataaatgggagagtcttacaacgttaggtcatagagttcggcaaagccaaatcatacagggtctcctaagccttagtaagcaccttggattttattctaattataaatgaattaattcattaaatatgttcaagtaaaatgtgcacaatctgagttatgttttaaaaagcctactttggatctttgtggagagtggattataggaagacgagaaaatactggggaacaaaatggggatgcttttggaattgccaggagagagacagtaaaggagcaagagggatggtggtgctctttcctgagagaagaagaggaagttgattcaagcaagaagaggaagcatcaaaagttatgttttgacacgttaagtttcagtcactatttgggaagcctttcctgaagagtttaaataaatagataaactttttctaaataaaccctttgtcagagccaatacacgagccaatacaacacctctttctgggaagctgcatggtagtagctgttaaaactagatctggaaccagactactgacatataaacgcttggttctctctgttactagctatgtgaccttcagtacttgaattctctgtccctcaatttcctcaactacaagaacagtaattacaaattctctctaatggggtttttaaggactaaataagttaattaatgaaaagccttcataacttgcacgcagtaagtacatgatacacatcaagtttgttatgattattcctaaactacagcgtattttattaaaattgatttagaatatattttcattctgtatgacttgtagaatctttcctgtactccatgtttgttaagagtattcttcagttcttaaagggacaatcactgtttaagtcaatgaaagaagacggagtgaggaaccgagtattagtgggaggctatatttagacagtagaattgtgatattttagttctttgtggaatccttattgatgtcatttggaggccatgcagtgagcttcagagcattacaaagtgagacctgtgacctgtacatgctggaagttgagctgtcgtctgatctcaaaatgatactgtctcttttccccagcaagtttaaagttattgaaagcatacctttccattattttttgtcttttcattttaattcttttactaaatcaattattactgtaaatatgaagtcagacaattatatagcagaattagaattattggaatgcaaaaatagatgtacaaccaatgtattactaaaaatgttgagttcttaaaacataattaaataaaagaaaatcgtttaactatgaacctgaaaacattagaaaaatattactaaatcagacatatctgagtttcaacacagccaaatctgctgaaggccttctcacatttgtatgatttggtatttttctaaagagcatgaatgaggattttgatggcatgttgtaaatactccgcaaagctgggaggcgttgtgtattatttcactcataaggtcacaaaacagaattatatatttaaaaaaaagaatgcattttataaatgaaaacctagagtgtttttggtgactgttttaatagaagtattggttccaaaccaagaaagttaagattgcattttcctggtttggtcaaactctacctgaacattacaagtgaggatggttgttaacctgccgagcctaataagagtgatgaagtctcctttaatcatgtctgtgtgagaaaccgaagaaccattatcttcaaataattaaagagctattatgtagaaaaaagtattctttttatctttgggcaaaaattataggaaaacaaaaagattttcaagcataaataattgcacaaaatacatgagaaaggttaaactacaggagttctcaaattctttatagtttttaattctcaagtacattttttcctgattctactctctatattctagaagaaaagctaaattacaaggacgtctaattgcaaagaataatatttgctcaagatgttaaactgatgtcatattcttaattacttgtgtcaaaactcacaaataatttcatagtattacatgtctcaaaattatatggaaaacttctgatgtgaacaatttctcacagagattctatgagatattttagcattctggaaattatccatgacaagctcagtgtatataggtggtatatatggtcactgcgagattgatattatttaatagttccctccacaaaaggcaatctatgtattataacctaagactctatttgaagaattatgaattctgactatctttctaagaaaggaggacccagggtctctggtcaaaaaaaaaaaaaaatgatgtacctctaaaagaccagccatttaaaaaataatacatacttattcattttaatgctacattttattgaatcgtaacaagtacgtacaaacaagaaaaaacaaaggcaaatgaacattagcatccaatcttttaacagatgtccacaactgtcactgaattcaaataaacacatttcactttctcattttttgtaggtataataacagaggatcaaaataaggaattatattagtaagactgcctcatttatttactcacaggtttaataaactgaggctagagcttgctgttttaattttcattttattgaaatttatatttgcccttccacaaattcattttgctgaatagatttctatttcccagccaagctggcaaaaagacttcttggtgcattagaattttgagtagtaacaagacaagtcagtaaataaaaataattaaaatgaatagtttatcatcatctaaatgcaaactagtacagcatagagaaagcctctgccatctttcccctttatttacttaacagttattaattatgctaatgcatatcatagtaaagaatgaataatgttgacaataagctatgaattgcaaagataagtatacacttcagcttatgggtatatttaatcatacaaaaaagtgtaactattgttaaaactccaagataatttctgaaaagacttgtggtcatttttaagacaccttatttttatcagttttagatttagagaaatattgcccttctaaacccaaaacccagcatttcctattattaatatcttacattagcaggatacatttattacaaataatgaagcagtattgatatagtgttctcaactaaagtctgtagtatttatatatctttagtttttacctagtgtcctttttctattcctacatgactctgggataccacattatatttaacatcatatctccttaggcttctcttagctatgacagtttatcagattccttgttactgatgaccttgacatgttttaggaatactggttaggcattttgtaaaatgtccctctattgggatttgtttgctgtttttctgatgattagatgggattatgtgtttgggagagaaagactactgaggtaaagtgctattttcattacatcatatccagggtatataatatcactatgacttatcagtattgatgttgaccttgataatgtttgtccactataaagttattctcactgccagccccactcagtcttacagtacccattggagggcagccatgatgctaacacttaaggaataaagagttacgttccacctagttgagggtggaatatgtacataattaattggaattcttctgcaagaaatattttggtcttttcccactttatttatttattcaatcatttgtttatatcagtatagtctcacagacatgtttttagtactttgtattaccaaatattattttttaattttcttgttcaaattccagatttgtaatttgaatgttgttcaataagttgttgttccatatttagccatttgaaagctctttcagttggctcttgtgtttctctgaatcattcacatccttttaggtattggtgttgtttttcatttgtttatttaattgttggtggtcttatttattcgtttcttgagcacttccttgcattctaacattataagatgctccggtttcatcttgcacatttccagttcagtcatataatcaaccatttccccaaggagccctggtttcttggattagacaatagtattttgaaaaactgatgtgagatctagatgtgttcactagttctgggatgtccttgcccctaggccttctcaggagggttatttgtatactaatcatgtatttacacgtatgtctaaatatttctatatgtaattatctgttgctatattaagttaaacatgagttcatacttaggtctctaactctagttcataccagatggatcattctagcctccttcccttccttatttgtaaacttccacactaataatgacacacctggtttccaccatcacctatccatttacttatattaatattgttaaattccactatatatgtgcagaagcatcagaattgttaagccatattcctgggggccacacctttatcaactagagtacagtcctgtctttatccatgtgggctgttacaacaaaatgccttacattgggtaatttatgaacaacagaaatttgtttctcatattctatgggaccagaagtctgatatcaaggtgccagcagatttggtgtcagttaaaagggcattcctcatagacagtgtcttctctagtcctcacgtagcagaaagggcaagatagcttgcttaagcctctttcataagggtgctaataccattcatgagggtgaaaacttcatgacttaatcattccccaaaggccccacttctcaatataatcacattggtattaggtgccaacatatgaatttttggggaaagcaactttccgaccatagcaaggtgcttatttcaagtttgttttgtgttgtttgtctttagttttccccactcatttccaaagttacttaggttagcgccttcttcccccacccacttcagtgaggttgtttgatacattaatatggttagatttcttcatattccattctgaaattccctgacctccttaataattagcttttttttttcttttgaccaagactctctctgtcacccaggctggagtgcagtggtgtgatctgggctcactgcaaactctgcctctcaggttcaagcgattcccctgcctcagcctcctgagtaactgggatcacaggcacatgccaccacgcctggctaatttttatatttttagtaaagacggggtttcaccatgttgatcaggctggtcttgaactcctgactttgtgatccgccgcctcagcctcccaaagcgctcagattagaggcatgagttacctcgcccagccaatgattagctttctaattagcatacattaaggttccctgtttttcatgtaaaatataatggattttgagaaatgcagactgccaggtgtccatgataacagtataatatggaatagtttcatcaccctagataattacctgtgctttacatattcagctcttccctgccccttcatgaacccctggcaaccactgctcttatatttttattttattttatttttttagatggagtttcgctcttgttgcccaggctagagtgcaatggcaccatctcagctcaccacaacctctggcccccgggttcaagcgattctcctgcctcagcctcctgagtagctgggattataggcatgcaccaccacgcccggctaattttttttgtatttttagtagaaacagggtttctccatgttggtcaggctgttctcgaactcccgacctcaagtgatccgcctaccttggcctcccaaagtgctgggattacaggcgtgagccaccacgcccggccaaccactgatcttttatcattgccatagtcttgcatttcctaaagtatcacatagttggaatcatatagtatgcagccttttcaaattggcttctcacgccagaaaaaaaatgcatttaagtttcatcctttttttttgtggtttcatagttcgtttttattaatcactagataatattccattgtatagatgttccaattcatttatccacttgctattgaaggacatcttagttgcttgcagtttgtggggattgtaaataaagctgctataaacatttgcactgagtttttttgtggacataaattttcaaactagttaggtaaatagctaagactatggttactgaattgtatgaaactgccaaactgacttccaaagtggctatatcattttttcttgtctatcagcaataaaggagaattcctgttgctttacgtcctccctagcaattggtattgtcaattttggaaattttaaccatcctaatagatgtgtactagttttttattaaaattgaaacttgcaattttctaatgacaaatgaaattaaggatcgttgtatatgcttattttgcatttgtatatcttctttgatgagatgtctgttcagttgattagcctgtttataaattgacttatttgttttcttgttattaaactttaagagttatttgtatattttagagagcaatcccttatcagatatgtattttgtaaacattttatctcagtctgtagctttccattttttaaaatggaatttttacaatgtctttccatttttaaaaatattgtctttggcaaagcagaagtttttaatttaaataaagacttacatagcaatattttcttttatggactgcgcttttgtatctaaaaactcatcaccaaaactaaggtcacctagatagtaccctaagatttcgtgtaggggttttataatttttatattttacatttaggtgtttgatttattttggattaatttttgtgaaagatatgaaatttatgtctagatgttgatattgtttcatattgctgcatgtattaatgtaacagatatccatttgctgtacagactctcctttctccactgacttgtctttgtttcattgtcagagatcggtggactatgtttgtgcatgtttatttctggcatctatattctgttctgttgacctgtgtgtctattcttgtgacaataccatgtgtcttgataactgtaatattataagtctggaaattgggtagtttgagtcctctgactgtcccttttcttcagtattgtgttacttattctaggtctgttgtctttccatataaacattagaatcagtttgttaatatctataaaatagcttgtcaggattttaggtaggattccatagtcttctctatttttttttcttggataggctcactagagatttatcaatttcatcaacgctttttcaaagaactagcttttgacttaattggttcaatttcattacattaatttattttcaatttcattaatttctgttctgtttttatttcttttccttttttttttttttgagacagagtctcctctgtcacccaggctggagtgcagtggcgtgatctgggctcactgcaacctctgcctcctgggttcaagtgattctcctgcttcagcctcctaagtagctgggattacaggtacatgctcccatgcccagctaatttttgtatttttagtagagacagggtttcaccatgttggtcaggctggtcttgaactcctgacctcatgatcggcctgccttggcctctcaaagtgctggaataacagatgtgaggcaccgtgcccggccttttgatttctttatttctgcttgctttaggctttaactgctcttctctctctgtttcctgaggttgaaacttagattattggctttagagctttcttcttttctaatgtatgcattagttgctattaatttacctccagagcataccacaatttttgatgttttattttcatttagttcaaatttctctgaggtatttatggactcatgtacagtatagaaatgtgttatataatctccaagtatttggagatttttacctcagtctttccctgattaatttatagtttaattcctttataacccgagaaaattatttgtatgatttctattctttttaaatttggtgtgtttcgtggcttatgatgtagttactttggtgaatgtttttgaaaagaatgtatattctattgttttgggattgaatattctaaaaatatcaattaaatcatgttgattgacagtatggttcaggtcaactctatctttactagttttctgcctacttgatatatcaattaataaagagaggttttgaggtttccaactgtagcaatggatttgtctatgttttcttgcaattctatcagtttctgatattctgttattaggtgcatacatattaaggatactatgtcttcttggagaactaaccagtttatcattttaatcttcctctcttcttgtgaagtctgacttgtctgaaattaatttagctacttcatttttcttttgattagtgttaccatggagtacctttctccatcttttttacttctatcctatcctagtctttatatttaaagtagacttgtaaataaagtttagttgagaattatgtttttatatccactctaaaaatctctgtgatttaactgctctattaagaccattcatatttaaagtgctattaatatgttcactatgtctgtaactgttttatatctgttgcagtagttttttgcttctttaatctcctctttttctgccttgtgtagttttaactattttatataattcaatttgccccctttcataggcatcaattacacttccttttacatttttaatagttactcgagtttgcattatgcatttctaattaatctaagtccacagtaaataacagtaccttgctttctatgtaccagttctttcctccagtcccttggaacattgctgccattcattttatctgttcatatgttatatacacccaatatgttgttgctaatattactttaaacaaaccattatttcttaggttaattgagaataagaaaaatgaaatattccatattatcttcatttattcatgctctttatttacataaatctgagtttttgaaatatactatatcattttccttgtccctgaagattttcttttaacatttattgttgggaagctctcctggagataaattctcttagtttttgtttgtgaaaatctttacaacttcttcacttctgaaaaataatttcactgagtatagaattctattaacagtgtttttgttttttttttctttcaatatgttcaatatttcattccaaactctttttacttgcatagtttctaaaaatatgtcctttagaagtattactcctgtttatctactggtaaagcattattaaagcccttcccacccactctgacttctttcgagattttctccttgtcttctgttttctgcaatttgaatatgatatgcttaagtgtaatttttttttgtatttgttctgattggtattctctgtttttcttggatctttggttttgtgtcactcattaattttgaaaaattcatagtgattattcaaatattttatctctcagttttggatgttctttttttctccattgttttatcaacaaaaagagtcaaacactgtaaaatatttgaagagatttattttgagccaaatatgagtgaccatggcctgtgacacagccctcaggaggtcccgagaacatgtgtccaaggtggtcggggcgcagcttggttttatacagtttaaggaggcatgggacatcaatcaaggacatttaagaaatacattggtttggtccagaaagccaagacaactctaagaagggaatgggaagtgggggaggggggcttccaggctataggtaaatttaaacttgttctggttgataattggttgagtttgtctaaagatctggggtccatagaaaggaaatgttcaggttaagataaaagattgctgagaccaggaggccaaggttcttttgaaatcttattgtggctgcccttagacacaacagatgacaaatgtttcctaattagtcctttaaaaggtgttggactcttagttaatctcttcaggattgggagggcctggaagaaaaagatctagcaatgttaatagagactctctacagatgcaaattttcccccacaaaggacagctttgcaaggccgtttcaaaatgtagggtaaaatattttgacttctttgttacataatgttacgcaggagtcacattggaaagtaagtcgcaatatatagggttcaataaacccatctgatgagaatttatggtttgtagaacatgactgtccaaaccccttagataggaatttgggcaagataaaaaaatatcagagctagtcttcaatttcttctattttaattttagcttaaggaagttcctattgacaaatcttcaagcccagtgattcttttctcagccacgtttgttctactgataaagccatcaaaataattcttcatttctgttataaatattttagaatttctagcatttccttttaattcattcttaaacttcccactgctatatttacatgatccatcttttctagctatgtctacttccttcattcgagcccttaacatgttatagttactttaaattcactgcccactcattgcaaaattttgtcctatatgaatatagttgttatgcttgatttgtctcgtcagactgttaggatatatcaggtaacaggaactgactaactaataattagatctttgtataaggttttgtttttctggggaaattggcctgtattgaatgtttactgtaggtttaggtataggtgtcaaaaactgagttctaatgtcttggttttcatgtcccctttgtatttgggcttctctaaggactcctctttatatagaggctatgtctttcagctctttcagctctaacccaccgtttttatactgtaaccctattactatgatgggaagggatgggggaggggagcattatataattttaagattaaatcttagtcttttagtgggctttgttcctggaatgtagccttcataagttccccttcataagtttcctctctttgcccatcccagctcccttaggtgagacagataagctagagtagactaaagtccttaggaaaatgacctttccccaacttggataagactctagtaaagtctttttctcttgacagtaggccttaggcctttgttatggagaaccctctaggcatattttacaaaggttactttttctttccctatgccagaaccatgagagggtttttcttggattttcttcatgatgacctggtatgcttagtgtacaatgggggctccctaagactattgctccaggagtttctgactctcagcttccatcaattcattaacgttatcatttaagtgtttttacctgtttatgggtcctgcagtttctgctgtaagaaaagagaccttggttgggactctctagattttcatatctttctaaaattctgagcagtggtttgctgtgaaatctcagttttctaatgggtccaagaaaacttgcagattttcagtttgtttagctttattcttgtaaggacaagaagacaatcttcaaactttatataggatggagctgaaaccagaaattcctcatagtcattttttatactttatttctagagtagttatattaaataattttaaagatctgaatgttaataacaattggaaagacaagagtgttcaggatttttaatgaagtgatatatttaatgaagtgatacatttgtgatgtatattcatgtacattgacagtttgttaagtaataataaataagtaaataataatggatatttgacaagcaaatcaaattaatcttacaactacatgagataaagttttttatttccattctatagattaacaaattgagaccagaatttttgttcttaaccattaattattttaactcctgaaagaatatgaaatttctgtccatttcagacatttgggaaggcagataaatatatgttaaaaaaaagccaaattaaaatggatagattaattgatcactttgcaatcagaaaatataatatgtcagattaagcaagtgtatatatatatatatatatatataatccttctgttcttaaaaaatataggcaaaagaataaccgttattttaagtaattttttaaaaaaattattccttggcatctatgtttctcattattaatatgaattatcttacttgttaacacagaaatgataaatgctatctagacttttgttttgttttatgaccaaatgcccataaatctttctcaacatttattaatatgccattcaattcctatatttatgttctataaaacagtgttttaaatttaaaaactttttgatggcaagctataattataataatcgaagttgttttcccgtaagtaaattattttcagagtacagagtagataccaggaaaacacaatgatctattgtctctcatgtctacaatttgttgaacaagatactttaaattaaagcttgaaaaacatctctgctggtatttgaaataattagctgtgaaagtcacggtccaagacccttttaagatttagattttaagtgctttttcttctagttgtcaagtcttgacattttatcatttggtattcaaggaaatggagactatttcttcctccgaacactgtagacaaattatatttatgctagatagccaatataatggaaagcaacctggttttgatatttaaaagtattggcacttctgcctaaaaagatgcttgcttacccacgtaagaaccaatatctgtatttaagtaaaataacttgtgaaatacttttttagaatgaaattttctagtggaaaatattatattttacattcagccagtaaatccaattctctgttaggaatttctccttctaagtcttagaaatcttaaatttattgtctctcaaactcagcacatctctgtcctcctctgtcccttcaaaatgattaaataacataagaagatctcattgaaggtaacatcgtatagtttccttgtttgtgttttttttaatagtacacctgtagaatgtaagctcttcaagggtatgacactctgctttagtcactgataaatcccaagtacctaaacagtgccagacacatattaggtactcaattaatattggttatatgaatgagggcttccttctacttgaatataatgtccctcagaactgctatttcttttggcttaccactgtatctctagtgcaggagcaggcattcaataaatacatgttgagtgggcagccgaatggtggattgaataaaattacatcagcactaaaatactggtgctagaaggggaatatggtataaatatccccttccctatgtctctagacaacatatctgacttaccaatcatccattttacatgttaggttgtgatactcctgaagaaaaagaagtttgttcaattttttatgatttacaatggctttatattttcattaattttttccaaagattgaatgagcttaaaacaccaactcagctattaggacagacaggcaaaaaacatgtttgttttgagtctttcaaatacaaagtttggatatttcaattgtcttcaccatttaggacaattttcttcagataaaaatttaaaatcatcacttcagaagccatttaaaattccaacaaaactgaaagtagtaaagacctaattgaagacaatgttgaggtcttatctacatttgtgcacatgcggctgatgcaataatgatttggttattgtgaacatgatgataactatggtcaaattaaacatatttatataggcatattttaggaatatgaaacagataacttagccatgctattatccaatcatttcttaattgcatgctaattttatatactcagttgtgattctggttcttgtactatcaagctgtctattttggtagtagatatatgaaagcacctgggtaacatacaagttggagaaaactaacactctttcttggtttctttgtcactatcacccttgttgtgaaaaaagatcatagctttttctacctaatccccatttcatctttctgtgttatttgtttccctttagttgtaacacaatgaactcagattaataagaaaatagcatcacagtttaagataatattgattctggagaacaaccgagaatgctgtgtgttttccttgacgaattgataggatggaattctagaatatccttctgaagaaaaattcagcaggttataaaacccaggctcaatgaccccagaaaaccatgagtgtttgaataaccatcaacaaggggatggatgattctggaaggttaatataatatgtgccttttttgaaacaatctttatttgcttttatgtttctacagaaatgctatccacattcacactaatttgtggagtttgtgtgtgtgtgtgtgtttcttcacccttaggaatcacaaagagaatactttgagaaaaaaaagttctcagaaaatttgtcatttttgtaggatgctgatcttttcactatttctacaaggtatgcagctgcatagcaagcagggatacagaggactttcctgctgagctaacaggtttctgttgtgatggaaacaagtaaaaattatagtaattttgagggtcagtagcacaactatcctacatcatatgcttagatggaaattttgtatgtcagctggattataaccactgctgatttcttaaccctgcttaatatcagggaggattttacctggcactttcggttcatttcctttaacaaaattacttttaataatgttattcttttttctcatgagaatagtttactactcatctctctggtttcttactaacagaagcttctgtttactaacaattaattctggctatgttattgaaacttaagaagcaataatataggagaaaaggggatcaacacaaaatgttttttctttccttaacagctacccagacagtagtcctatctaaacagggcagcatcttcagaaatttctcagaagcacaccaaaaaaatcataaaatgagggtaatctgacctctgcctatgcaaagaggtgatgtttaatcttcccactgaccaaagaatgaaaatctcattaaaaagtagtttcaaggtgatggaagcaggaagcaagagatgtcagaactctcaaattgtgttctttattcacattaatatagttatttaaaacaagtgttagtgtgggtgtgaaagcaaccttttcttgcaaataaatcccataaggaaatatgtataataaaagtgaactttactatatgataaaatttcaccctgtaatttgtgtggttagcctaaaagatgtgtcatcaagataaaagatctcatctgggatgctgaggattaaggcattcagttttttttatcctcaaaataaaatcgaagcattatcaattaccatttgccagaactgactctgtctctgactttttgacttttgcaactctctctacgagcctgtgttgtcaatgtttgtctttagctataatgatctacacacccaccttggggaattactatgcaagtatcattaaaatggtacatgaaaaatcattttgtgctctcaggctattcagatactgatataaatacaaaggataaatttgcaagttccaggtcttggtaagcttcatcaagtttataccaataagagacaatgccatcaatttctgaggcagagtgaatgggagtcatgattaagactgacataagcttggcccgagtttttggactagtaactgaaggtttgatatgtcccaaagacataaaccagcacaatatgttttgcaaatattttaattagtttaaaatttttaagtcaagattttacataacaacacccatttccagattctattgaaaaattttaagatctaaatacaagaactacactgcttagtacatctttctgcctgcttcacacatctgagatcctgatcctgtttcagataatatgtttacgaagtcaagagtatggactgactagaagttttagcaacggataccagttcaaggtctattttattttgtcagtatcttaaaattgttaacaatgacacatttgagaatttattcagaatgtaaataacaagataattctttccaccaaaaaaatttatgttctgatactaatttatctgtgtttgtacatatatgaaaatgcagaaacttctgtgtagattatttgagacccattgcatgttctgtaattgagttcaaactgaggaaggaaagagatattagaagaataacagaaaaaccttaacttccacataacattttatgctattactcttcagttagagagtctttcttgacttccttttgctcagtgcatagagttcagagacctgtgtattaatttttttgtgtgtggcttcaccttatctttcttggttcatttcttaacatttttctaagggaatttatctaataaagtttgaataaatgaataatgggagaatcagaaaaagtctccacatttgtttggttttattaattcataagatttaaagacagacatacttggatcaaattctagcttgccacttaattagttacgtgatcttgaagaacttattaatgatatgatgtaaacctttctaaacactagtttatcacctggttcttagtattcatgtggataaaattacataagaatacaagtaagttttctcctttttcccatacagtcctcccattgtgttagttttttgatagtgttccatttgcttaaaacatttcctaggtgtcttcaacatataaaaagttaatcatgcctaatacaagaatcatacccatcacaatattttgttaacatctcctgtaacagagtttcaaccacataatttattatttgtttaatgatttaaggtttttctcagtgactatgttaagatttttcaagggcaatggaaataactcaactatctataaaaatagcagggatgatgaaaacaattggcatttatatatcaagttttgataaaccaagggctttcacatactttatcatatataagatttactactcaaaaagccttgtaaagtgggtaaggtaggtattgttcttattaccctaatttcatatgtgagctgagagacctagaagacctagaggacatgcagatttttgcctatagttagaaaccctaatttatatcgtctgcctttgaatccagagtttttctactacatcatattttcttccaaggaacaaatagaatcataggtatatggttgattgtgacaataaaagttcactgattgatttatgaaaactaagataggttttagaatacagataatcttttcttcacagtttcacaaatgtgtatttttattgtcatctgcatttgtagttatgataaataagtttgctctaacttagagataaagaaacaaagttttttgattcaccagggatttccagaccaacagcccttgggaggtgctttaagattgctaaaagtttgtaacagtagcaggcatcaccagagcccatcactccttagagtagtacactctggtttccatgtccctgtgaagactgtgtatcacatttctgtccccaaaaggtgcttgtgtcacatccctgactccaaaagtgttttaattttttacctctggtaaatacattgcccttgagtaatgttttatccttggaaatagtttcttatgacccatctgaaaggatgttagtttcaatgggctctgggatcccagccctcactactacatgtggtttctacttaatggattctgtctcgtctgtccctgatattttttcaagttaattatttgtagtgatatcacagtgaataaaaagtcctcaaggtgaaaaaccggaatagtgcttacaagtaaatggccaacctaatgatgggtctgaaatatatgcctcaagaaggtacaatactgtttatattaattttacaaggtcatagataatggatctgtactattgtaatcaaacagaggacgcatgatataatccaaaagagacgcaaatgggtctgggcgctggagattgctcatgttaaaggaaaggtcagaatacttatgcaccatctactggatggttaagctttcaaaaccaatgtaatcatatacaaatgcgctgagattgatttagattaggtatgcaagcatacctagtctttatattggtcatcagccctcaatatgaaaaagattcttcagtagattgtggtacattatatgttaatgaatttgacttttttttttttttacggtgaccattgtgtcacattccaattcatacggattagaggttcccaacccataataagcctcagaatcacctggtgaatttgttaatacacagacttctgtctctctgttaagtttctgatttactagacctgagctgggaaaaaggaattatttctaacaagttcccatgatggccgggtgcgatggctcacgcctgtagtcccagcttacttggatggctgaggcgtgagaattgcttgagcccaggaggcagaggttgcagtgagccaagattgccccactgcacttcagcttgggcaacagggtgagacccagtttcaaaaataaataaataaataaataagtaaataaatgaaaataaaaataattaaaaataactagttcccaggtaatgctgatgctgctggtctatgggtagcattgatacagattaaaaagttattagtgtagcaaatcccccagataccctttattaaagcagtttcagatggtctgatttagcctgattccactaccattataaagtgttttcttgatgctaacacaccttgctagagcactaatagtggctgagaatgcctaagaatttttatttgggatttattttttacataaaataatacttgcaaataatgttttaaatccaatcatactatgaagactatggtggtaaccagcaatcctcttacccacctcccctacttgcaatttctgataccaaggggcaactgtgtcaatcttttattttcattctgtcatatgactccatatttatagataacgtgtatatcactgttctctattttttcctattttggttttatctactgctttcccattatagaaaatatctatttaactgtcttattccagtctttccctcaacctccagtatacttatgttagttaagccaatattccggttagattattcatatctgaatcaaacaacctgctatgattaggatttcttttttatacattgtttttgtttcttatagccttatcaactggcccacttttcatttgcttagtttttaatatatatcattaatgcattctaatctctttggaagaactgtaattctcatttcaatattttttttaaaggaaagaagttctgtgtgtgtgtgtgtgtgtgtgtctgtgtgtctgtgtgtgtgtgtttctgtgtgtgtgtgtgttttcccacagagacatcctttctggagcttctctcctttcccttatacagttggactggaggatctctggacttgctaccattttgccacctctctgcaatgttgtatctttttccttctgtctctaattttgtttgtttttctgtttctcagtaggattcctttgaccttcattttccaaactgtgtcttaatttttctctccctgatatcacatttttacatttcaggaactctctctgattctctaaatgcttctttttaaaaatctgtatctccgaaggaacttttcttaaagttctttgagaaaattaaatttagagtttttgaagcttttatctgcagcttacattgcctctgttttcttcaagtttggtatgctttttgtttctttttggtctcttaattatacgttaaaggctccccaaaatccctggaaatcttttgctgcctattcatactcatgagtgaagtcgtgaaaatagtgatatgaagttctctgtgtagagaagggcttgctaattaggctatttcccacatggttactgggtgtgcacctaggagccagtacctgcatctcttccagttgatttcaattctccaggtaggaattcctccatctcttatgtaaggatgtaagctgtggactggcagctttctggaggtctagtaagggaagataacttcattaacaatgtttgatacataggctaacaacataggctaacatggaaccctgattttcactgcagtttgacaaccttatatttaactgtttctggtggcctgagaacataccattgacgctccagtcttctatgggtgggagtacagtggatggccctcagaaatcactcccttgtttgagtcgaagagagaacccagaagagtctaactgccccttattaaaaatggtcaatctttatcttttcacatttaacctgacagtcagatatataaagtgtccccagtttttacacattttgaaaattccgtgccataaaaaaatacttccttcccagcagttcccagctatttacaaaaactttatgtgagttctagtatcttctttcctgatgcatctgatgctttattgtcattttcatttggctgctggagagagtaaatgttaacttttgtgttcaattaacttttgttcaatctgcattatattactacttattaagaattcgctatattacatatatcaaaataaggaaaatagagtgtccctggtattcagagagagcttaaacgctggagtttacacaagaatacctccatgtttcatgtcaaaatttattttaaaattatctattttaatctgaaagttatgtttgtaaattagtgttatctaaatcagtgtaggagattttcattagtgttcagtacttatcactgtaagagcatggctgagacaaaacatgggttacatatttcatattcatttgattctttaatactttctttgtatagctgagttcaaaaatttctaattataagttgatcatcaattcaaaaaaatgtttgatttttttaaatgtttgctatatatccccaaaactgtacttttccattttcttttacttttaccatgtcattttctatttacttttccataacttttgtttcatcttccttttaaaaattatcagtattcctgatattttacataaactcaccataatctgtatatttgtccctctttttttctgagctcaccaatattatgagcaacaaattctttgaaatgtgtagattatagtcacctgattgggaaaatcttttcttttattttcaactaccttttttaagaaaagaatattatgccccatttttatcctttcaaaacaagtatatcttttataagctatgaagatgggctaaaggtagataatttttcaaaagcataatggctgtattatctaaaactaagaaataagacattttatgtcttgaaaaggctgttagaataaaattacctcactgaaattattcatcttttggctaaattgacttttttttgctttctagaattttattttcttcattcagtggatgtattacttatttctgaaaaagaacaaaagaaaaaatagcatgtgaatttgaaaacacttattttacattatcttgactacaagattgtgaagataagctttattcaaaatgattattgtttcttattaccagaaataaacatcataaaaaagaagtagcttcagcaatgtacacagaaataattttcaagttgacattataacatatcggactttggaaaagcataaactatattttgtgactacagtggatgaatgggtgataatttcaactataagtgtaaacatgcactatgtttccagaaatctagatgagagacagtatttaatagtttttaagagcacagttttggtcttaacagaactggtccaagtcctggctctgccactgtggtttacctcaagccattttagttatttgatcctcagtttactcggcagaaaaatggggatttacaactcgaggctatcataaagattaaacaaacttctatacacagagtatttaacgtagaacctggcacatagtgagcattcaatgaatggttgctaatgttactacaaagccgttcagatatgtttgatcaaaataaataaaactgtaccaatcaaaacaaaattaattaaatgcaacaccaaaattggtagcattaccaatatttacactttgggcaaataaaaacagctaggcatttatgcttacaggtgacacgctaaatattagcgtctctggatgaaataaaatagggaatgatagttgttgcaggagaggtgtgctctcattttaaaggttaaaaaaaagatttaaaatgtgtataaatctggtcaccagcgatagctttcttttcattatactcagaagattcacttatttaacagatattctttgattgcctattatgtgcccggctgtgtttacctaccatgcaaaaggaaatacctcctttttatgcttgaatactttccttttccacagacatttccactgggcctgggagatgggcaattctattcatggacagatggtttgagaagaaaggactggcatgactatgaaagcattcagaaagaggctatgcgctcaggtatgaagctcagtgtacgccaaagtgctatttcactcgcagcagtgtctcatttgtcacgtaaaggatctctaattagcatttcttctgcacactgtaaagtatgtttcatggggatattggaggtgatactggacagaacctaaatgacttcaaatttcagagagaaaacaaataatgaatagtctttctaatattagctgtggtaaaagtcattaaaatttaagaaatatatagtactatatattcccaactgcttgttcataatttctaggggtatcctgggatttatcaatgagacttgacctggtagatatgtatcttgagcaagattgactccttagagctgaagtgtatctaactggcaatgcaaagtatttaatttgtaccaatgtttctagacactggcgggacgtacagcaagccagcaggtcaagcagctggggttctaaggttggcaatagttggaaaagcaatcaggcagttaaacggaatcaagtaggtctgtgtgtagcagagttctagacttggtgctagagttaaaggacaaagtagcaagaaagaataggtctttccactttgggagaccgaggcaggcggatcacaaggtcaggagatcgagaccatcctggctaacgcgttgaaaccccatctctactaaaaatacaaaaaattagctgggtgtggtggcgggcacctgtagtcccagctactcaggaggctgaggcaggagaatggcccggggggtggagcttgcagtgagccgagatcgcaccactgcactccagccgggcgatagagtgagactccgtttcaaaaaaaaaaaagacaaaaaagaataagtctttctagaaggactgaaaaattaggttgttaggctgttgtgaacagaaattcagaagggtatatcagtagaaatccagtgaaagtgagtaactcatgataggaagcccatattctcttattcagccaaataagttattttcacaataaggatgtcacagaaatggagcagctacagtttggtaaagacatctcagcagccctgagacactgcattcaaggtaaaatcagcagcagaattataacttagccagggtgtgaggtcctcttgttcaactagagttagtaacaaaattgttctgggctgtgaaatgttcgtagctctgtatcaggtatggctgactgaattacagtcttttttattttcttgcattccttttcttccaaaaaaggcctgccccacgccccacccccagctttttaaagcagcttattccaaagatgttccctgttttcagagcgtcaacttcttctaggttttatcatctttccaccttggcagtgaccccatgaatggtcgtgaaaatgagttccttaccagcatcctcacttttctagtacttttatttttttcctctatttgcttgatcaaccctatattaatccaaccacttgtttctccttatgaccccaggatgctgaagttttttggaaatgttttcataatcttaccaactgaatcttccacaagttaataataaaatagcccaaatttactgaatggatgttttatactaagtgctttgcatatgtattttatttaaacctcagaataactctgataggtataattatcccaaattaagtaaaattgagttcctacaaatttattaaattttatccaagttcaagtagctaataatttgcagctctggattaagaaccaggtcttatcatggtccattatactccactgtcaaataataataattggaaaatatggagtaatagcaaggacacaacaggagaaagacacacctaggttcaaatcctagcatttccatacatgcactgtggcaaatcaatttctgtttctgatattctactttgtagaatttatttaaggattaaagaaaatatacccacagtaattgtccaattatttggacatattggaaactcaactaatgataactgtaattattaatccatgtaagttacttttacatgaattggtatgcctatcctttgcttgtacaaatgagttttgaatacaaaatccagtgcttcacatttatatctgctccataccaccctttccacctcctgaataaacttgtcttttctatcttcatctttgctatgaccaagggaaaattgatcacaaaagaaattggtaatatcacaagtttttaagtacaaattctttgtgtaattgaaaagcttttacatggtagaattttttttattcactggaggatatatgataaatttatatactagaatattatttttatacagtgaaatatatcataaataaaagtgtattaagacatacgtgtgtgtacacacacactcaggtacagagtcaaaatcaaataaacatctttgtacttcatatacaggccaaggaaaaggatcatttgtgccattgtgtcccctctaagactttaattttgtgtttactctcttatttttctctgtagtttttactgccagtgtatttatcctgaatcaaatactggtaagttttgccagtgtttgaactttatctaaaaatttaattttactgtatgactttcttctttcactcaaaaatatttttgagatttatctaggtcaatgtgtgaaatgttagttggttcatttttactattctttaattttctgtaacattgtcctcttggtgggcctttgaatagttttagttgttgtatataatgctgctataagtattcttgtgcatggttctggggtagggacaatattaaggtacatatttaatagtagatttgtatgtctagagaatgcacagttgaactttattaggtcatgacaagctgccaaaattgatacaccaatttcatttcaatcaataatggatagaattctcactgctgtacatccttgtgaatatttgaaattgacttttcccccaatttggtgatatgaaatagtctctcactgtcacttagatttgcattttattaatgcaagcaaattaaaatgtagttgatatcttttttatgctatggggacatttgttcttcctttttggtaaaagtcctattcatttctgtttccatcttttgaattatttgctccacacagtgttcttaatttattttaaatgatatcctttggtggttttatttagtgacaagcacgtatcctacattttgtagattattttaaaacatctctttatgtatggtttaatgaatagttttcaattttgaggtagccaaatccagcaatcatttttaaaagataggtcatactgatgttctacattgtcttttaaaaacttgataattttggctgggcccagtggctcacatctgcaatcccagcacaccgggtggcagcagagggaggatcgcttgagcccaggaatttgaaagcagcctgggaaacatagcgagacctcatctctccaaaaaaaaaaaaaaaaaaattcatccgggcatggtgacatgtgcctgtggtctcaactacatggagctgaggcaggaagatcacttgagcctggaattcgaggctgcagtgagctatccagcctgggctggagactctgtctctaaataaataaataaataaataaataaataaataagcaagcttgataattttacattttacatttgggtcttagatccacctagtcttcatttttacataatgtgaggtagggatccaatatttatttagtttttattcacttaaccaattattattaacatttattaagaaatttgtctttccctccattgctctgaactattgactctattataaattaagtttccatatttatgtgttctttttctgggttctctatcctgttctgtgagtaaaaatccctgtgctaataccataatagctaatgtactatatctttattacaactattactatctggtatagctcaccaaaaaagagctacattcttgctcttctttttgttgtcattcttacattgtactcttccttaaaattttgtattcggttttaaatttcacattaacatacacagatatgcacaaaaaaatgggaatttttgaattgtatttagcctatggataaattaggagataactgatattttccaatatagaataatctattctatggtacattattatatttatttgctacttatttattatatttaaggatggctttgtaattttgttctcagattatgtttagtattaatcttagtaaactaatattatattgattttgttcacataatgattatactgaaattcctcgttgtttgtagttgtaatatagaaatgttaataactcttaacactgatatgaatttagaaaatgttctaaggttttccattaattcaaaacatttaccaatagtttattttggattttaaaaatgtagacactcatatttgctagtaatgacagtgattttaaaaatgtttttttctattctagaccctataattttagttttagttttctcctattattataattgctaagaactgcagtgtaacattgaatagttggtaataatggctacttttggcattttatgattctcacaaaagcaatttaaatgctcattttgagattttatctgcctgtctattgttagatcaatttgtctaatgtaaatacattttatcatgtttattaacacaataccaatacactatgcactttaacaaatacacttatgttacttctgaatctgttttgctgagagtttgtgactttcttttaacctgaaggagtgctgattttattaaaagttttttgttcatttgcatttattaacatagataaatgttctcctttaatctgttattgggtaaattatatctattgcttttctaatggaaaccaaatttgttattctagactaaatcttcctttttttaatagctacatttgatttgttaatattttgtttggcattttcaaatctttatctatgaattaatattggccccaaattttctattcttatcaagtctttgtcaagttttggtaacagtataatgagctcataaaatgactgtttaatacttgctgttttttatacttcataattgtttgttgtaaactaaaattatttctttagtgatcattatggatttttttgtggatgaagctctgttgacctgaacttttcttggagcatagatttttaactgcttggctaacgttttatgtagttacagtagtagttgattatctatttcttctggaattaatggtattcttctagtaatttgtccattatatctaaatgtttatatttattaatacaaatttattcacatattcttatgtcctcataagattttcgtaatgcctgcaatgcttaaatttatattacttttttcagatattgttagttttttttttctttttgctttcttaatctatttctacaaaaatttgtcacttttttgtttgtttgtttgagatagaatttcactctgttgcccaggctggagtgcagtggtgtgatctcggctcactgcaaccttcacctgccgggttcaggcgattctcctgcctcagcctcccgaggagcttggactacagatatgcaccaccatgcccggctaatttttgtatttttagtggaacagggtttcactatgttggccagaatggtctagaccttctgacctctggtgatccgcccaccttggcctcccaaagtgctggaattacaggcatgagccattgtgccaggacaaaaatttgtcacttttatgagttatttcaaaagccagtttttgactctgttcatctattttatttttctctaatttttttctaactttttaaaaattttgtttgcagtaacttttttattttttacttttaaaatttcaacatttatttttgtttcaggggatatgtgtgcaggtttgttatgagggtatattgcatgatgctgaggcctggggtgtgattgaacctgttactccagttctcagcatagtgcccagtaggtagtttttcaacacttgcccacttcactccccctgccctgtagtccccagtgtctactattcccatctttttgtccaggtatgcccagtgttaacccacaaatgggttaactcccacttataagtaagaatatgtaatatttcattttccgtttctgggttaatttgcttaggataatgacatctaagtgtatccatgttgcagcaaaggacattatttcattcatttttatggccgcatagtattccatggtatacttaaaaataaatttatacctcctaatttcagtcatttttctattgtagaataagcattttggaaactaaattcccgtctgaatattactttaactacattgcactgctgtgtgatccagtgtttcacattgtatttgcttttctttcagtatgttttgaaatgtctagcccacttaaaaagcactgaaattattttaaaataagaaaattcagaaactccttcccaatgaaatctcactaatctttataaaagtatattagctgccaggcgtggtggctcatcccagcactttggaatgccgaggcaggcggatcacgaggtgaggagatcgagaccatgctggctaacatggtgaaaccccgtctctactaaaaatgtaaaaaaattagccaggcatggtggcaggcacctgtagtcccagctacttgggaggctgaggcaggagaatggcatgaacccgggaggcagggcttgcagtgagccaagatgcgccactgcactccagcctgggcgacagagtaagactccgtctcaaataaaaaaaaaaagtatattagcatgataggcagcatgcatttcattacatactttgttagtgttttcattaatgttgttacattacatttctgtttcgttctggtaattacacctctgtggaatatttggtgattttttagatatcagttattttattttattttgttttacttttaattttaggtatacatttgcaggttgattctatagattgcaagttgtgggggtttggtgtacatgttgtttcatcacctagataataagcatagtattcaataggtatttttttgatcctcaacctcctcctacccttcatcctcatgtaggtcttagtgtctgttgttcccttctttgtctatgtgtactcaacgtttagttctcacttataataagaacatgtgatgtttagtttcctgttcctgctttagtttacttgggacaatggtctccagctccatccatgttgctgcaaaaaacatgatttcattcttttttatggctacatagtattccatggtgtatatttaccacattttacttatccagtctaccattgattggcacctaagttgattccatgtctttgttatggtgaatagtgctgcagtgaacatacacattcatgtgtctttatggtagaatgacttatattcctttgggtgtatacccaataatgcattactgggttgaatggcagttcagttttaggttctttgggtaatctccaaaattccacaatggctgaactaatttacatccccattagcagtgattagtgatcactaatgatgagtgatgttgaacatttttttcatttgcttgttgcctatttgaaaagtgttcatatcctttgcccacgttctaatgggtttgtttactttttgcttgttaaagtgtgtaagttccttatagattctggatattagatctttgtcagatgcatagtttacaaatattttctcccatcgcatgtgttgtccatttactgtgttaatagttttctttgctgtgcagaagctcttttgcttgattcagtcgcatttgtcaatttttggttttgttgcagttttttttgatgtcttcatcatgaaatatttgccagagcttaagtctaaaatggtatttcctaggttttcttcaaggattttataattttaggttttacatttgagtctttaatccatcttgagctgatttttttatattatgtaaggaagtggtctagtttcaatcttctgtatatgactagccagttaccatagcaccatttattaaatagggagtcctttccccatgcttgtttttgtcagctttgtcaaagatcaggtggtttcaggtgtatggctttaaatctggggtctctagtctgttccattggtctatgtgtctattttgtactactaccatgctgtttttattactgtaggcttgtaacattgtttgaagtcagatactgtgatgccttcagctttgttctttttgcttagattgctttggctattcaggctcttttttggtttcatgtgaattttaaaatagctttttttagttgtgtgtttagtttagttagtgaagaacgtcattggtagttcaatagaaatagcattgaatctgtaaactgatttgggcagtatggcattttaacaatattctttctgcctattcatgagcatggagtgttttcccatttgtttatttcatctctgatttctttgagcaatgttttgtaatcctcattttagagatctttcacctctctggttagctttattcctaggtattttatcttttctgtggctattgtggataggactgcattcttaatttgcctctcagcttggatgttgctggtgtatagaaatgctactaatgtttctacattgattttgtatcctgaaacattgctgaagttgtttatacaatctaggagccattggcagagaatatggggttttctagttatgaaattatattgactgcaaagaggaatagtttgacttcctctctttctatttagatgctttttatttctttctcttgcccaattgctctgactaggactttcagtactatattgaatagggagtgatgagagagggtatacttatcttgtgccagttttcaagggtgatgcttccagcttttgtctgttctgtatgatattggttatgggcttgtcacagatggctcttgttattttgaggtatgtcctttagatgcctagtttgttgagggtttttaatataaagggatgctgaattttattgaaagcattttctgaatctattcatatggttatatagtttttatttatagttctctttatgtgatgaatcacatttattgatttgcatatgttgaaccaaccttgtagcccaaggataaagcttacttgatcatgatggattagcattttgatgtgctgctgggttcaatttgctagtattttattaaggatttttgcatctatgttcatcaaagatattagcctataattttcttttttgttgtgtctctctgtcggtttggtatcaggatgatgctggtcttatagaatgagttagggaggaatctctcctactcaactttttggaatagttttagtaagaatggtaccaattctttgtatgtctggtcgaatttggctgtgaatccatctggacatggacttttcctggttggtagccttttttcttattccatttcagaatcaattattggtctattcatgatttgaatttattcctggttcagttttaataggttgtatgttccagaaatttatccgtttcttctaggttttctaacttgtgtgcatagaggtctttgtagtagtctctgaagattttttgtatttctgtgagattgtttgtaatgtcagctttgtcatttctgaatgtttatttggatattctctttttttctttattgatcttgctagtggtctatcttatttattctttcaaataaccaacttctgctttcattgatgttttgtattttttttatgtctcaatttcattcggttctgctccgattttggttatttcttgtcttttgctagctttggggttggtttgcttttgtttttctatttcctcaaggtgtgatgttagattgttaatttgagatctttctaacttttttatgtgggtgtttagtgttataaactttcctcttaatgctgcgttgtgtggttaattttaggatatgtgccatgtgctgataagaatgtgtatttttctgattttgagaggtgagttctataaatatctgttaagtccatttgatcaagtgttgagttcagaatgctgaaaacaggcgaccaatctcttctgtcttataaggtttctgctgaaaggtctgcttttagcctgctagagctccacttgtaggtgacctgctccttctctttagctgcatttaatatttttgctttcatgttgaccttggagaatctaatgagtatgtgtcttggggttctctgcatttcctgaatttgaatgttggactcttgtgtgaggttggggaaattttcctggatgacatcctcaaatatgtttttcaagttgcatgctttctctccctttttttctgggacaccagtgagttacagatttcatctcttgacataattccatgttttttgaagtttttgtttgtttgtttgtttgtttttgagatgggatctcactctgtcgcccaagctggagtgcagtggcacgatctcggctcactgcaagctccgcctcctgggttcatgccattctcctgcctcagcctcctaagtagcagggactacaggcactcaccatcatgcccggctaatttttttttttttgtattttttagtagagatggggtttcaccatgttagccagggtggtctccatctcctgacctcgtgatccacccacctcaacatcccaaagtgctgggattacaggcgtgagccactgcgcccaggctttgtttgttattttttattcattttttaatttacttttgtctgactaaattagttcagaggaccagtcttacagctctgagagtctttccacagtttggtctattctgctatttgcaattgtattataaaattcttgtagtgtgtctttcagctctatcagatcagtttgattctttccttaaatggcagttttgtctttcagttcttgatccattttattgtcatccttagattccttggattgagttttgagttcctccttaatttccataaccttcattcctatccatattctgaattctatgtctgtcatttcagctggttaagaatccttgctgggaaacttactgtggtcatttggaggaaaaaagaaaaagacacactggctttttgagttgccagagttcttgtgctggttctttttcacctgtgtgggctgatgttcctttaactgtggtgtaatttgattataatcagtttactttatttcagaacattttcagagggtcaaggttttgttctgggtctttattcgtagctgaattcttgtccttggttttacagggtgtaagttagcaaaatatttttgctattgaagtttggtctgtgatccagtagatggtgcttaagtgtaatggccagtaggctggtaggtaggctcttgctcagccctgaggctcttctatgatttctcacatttgtagccatcttagttcccttcatttactttaaataattgtttttaataaataggtggtatacgcagtggaaggcatgttgttaaatactagaggtgagtaataagaaaaatatattatttccacctttgaggaaatggagatttcttgaattaagaaaaaaaatgtaaaaggagcaattgaaagaccttaggacctcatgaatagcatcaggattctcttttggcacatctgtgcccttagagttaaacctaactgtaaagattattcacatttgttaatgttcaaagaaatccagagtttttattatttcataatcttacacttcattattttggtgttagcattggccaaaccaatgtattggtagaagaagggtatgaaacccaacattgcaggaccaggaaggcttccaaagagaggtaaaccaaatgttaaggcattaaggcatatgctaacatcagttaagagttatgcttttatccaattaactctgatttctccttcttatgagtagccactaacgtagtcatatttaaacattattgtttttcttatattttctatgtgtaataccattatagttcatttaactagttttatattttgtgagaatttattgacactgtattttatcttttaacagtttggctgcacctctcagctgtacattatcacaaaatagattagcatttttaaaatcttcattcagattattaataaaagttgaatgaaaagaatttcaatacaaattcctttaatacagtataaaagagaatgtacattttgatattgattcattattcaatatacattgagtataattatagtagctgaagagctatctagtcgacatttctccacgtataatttttttttaagtaatacatttctgaaataaaagtaaactctgcctatgacattttatggaactatagatctaacaaattgggctgggagttgaaggggaaaatgcaattgcttggataactgttttctaaatatatgatctttcctatttatcataacttccttttataagtggtaaaaacatacatgttaagtaatccattcagagatgtgtgtgtgtgtttgtatgtgtgtgtgtgagatgtgtatgtgttttgtgaaatcattatatcactgatatgttttctagaaagcatttgtttttagttttgaactttaaaattttttctttttattttaactcaaaatattgtcactgcatttgccacttgtttttggattaaaatatgagtgaactcaacgtttttaaaaagctggtttcaactgttctatatgatctattttgttgaaacagattatactctcatctaatcaatgtatgtattccactataagcctcaggaattctatgaaattatgtctttttgctacttcaatttgtcttaaatagtcataatggtaggtttgaatatccaaggttttattgagtcttctgtcattttattcatttactaattcaagaaatacttttaaatgccaaatactatagctctggaaggaaattttagaaaaaaaataactatagtggttcttgaaaagcataaggcattgtaggaggtgccctcgctgtttattggcactgcggccattctgatgcaaaccaccaatgtctcctgcctaaactatttcaataagtctcttaactgatcttgctccagagctcttcaaataaaagccagaaggatcatctgaacatatataatcagatcatttcactcctctgctcaaatgccttcaaaggctgttaatcatattcaaaaataaatccaactttattccactacccataaggcccaacatgatctacacctgacccatgtctctgacctcaactcttactgattggtgttcagtttctccactggccacaatagcctccttgttcttccacaaatatactaaacatgttccagcaatttttcacttgctgctcttgctactttgagcacttctcatacatatcttcacaaacctactctccccttccttaaggtcaccagatcatatgtccccagtttagaaaggcctgccaatcaccatattatcatatgtggatgtaattacttttattcactctctgtccttttactctgcttaagttttctttctagcaatatcttcctatctatatttacacacatgtatttacgttcaatgagttaaaatatatgatttcatgaaatataaccaattgtccaagggctctaagtcacaagatggtcttgaatcatttgaactgggcttttggaataacggcactcctacattaggaaagtatcctgagaacctgccacaacatgcttgctggtttcctcttttggagattgcttctcatttcttctttaatctcatgattaaagtcactaagcggttttactaattactgcaaattgccgtagatgaacatttaaaggatatgcattgaaaccccattcgagaagtgggaatttaccatgctttaaatgattaacggtaggctttcctaagttcctttaaacaacatctcactttagtgctgatcagggacctgttttgctcctaaatgtctttattctccctaattgaacaagattgtgaactaaacagaatgagaagcagaaatgtgcaccatttgggtgagactgactatattgccttcagaaagtaaaaatagcaaccattgctatggctacaatgggtttctggtcatcttttattgaagcctcatgtctcttaaaaatattatctggcaccctttttattactatccacaatgtcacattatttattgttaatagttcactataatttaaacatctagcatgtgctctcaatagatatcataatgagatttgttgggaagtggtcagctttgggaggtattaccaaaacaatattcattattattcataaggttaaaattaacttttaatgaaatatttcctttgtcactcattgcataataatgaaaatgtaaaatggaaatgaaaagagattgtgagcattctgttgagatgtatcatttagctgtctaaaattagaacacaacttaggctgagactaaattgaatgacaattatctagaggaaaaatcccttcaatcttaaaataaaaacagcagtgtagaaatatctcaggagatttattaaactgcaatcagtttatattaaaagatataaataatgccagcttttaaacagaattcaatttaactatttgttgcaaaactcataatatctctctttagaaatatcaacttcctatgggcaagtatgcataagattatttttcccagtagttaaaatgtggttgaataatagcaactatcacagatttatttgttaattaaacttcctgggctttagtgtttgtcttgcatatagaatatgaaggatatttatatcatcacataaccctgattgctgtgcctatatgactataacttgaagcaactagcatatgttttctcatgccatcaaatctattcaatggatacacaatctcaaaaatttttcacaagggggtctatataaacatatttcaagtagagctatttcgctttgcttctggatttatattacaagagaaacattttgggagcttctcccccaaatcttttttcctcttagtattgtatttatgcttttgcaaaaatccctttcatgtgttagtagttgtgattactatcaaattgtttctagctgtaaatgccccacatttgtgaggagtcatatgtgtagattataagccttgatcatgaagaaacaagaaaattttctgctgaaggaacacggtatctggcaagaatcaagacgaaaaagatcagaagcatctagtagagcaagggattggaatacaaattattgagtacactaagattaaattgattttatgtctaccattcattttcctcaggtcttttgcccaattttatttttcctagtttaactcgttcctgcatagctgctaaatgaggccaaaatgtaaatttgtattttctaccaatttgccacacagaaaactctaatacctaccgtacctaatgtttttacctcagctcaaatgctaatctttctgctaatagtagctctgctcttgaaattccatgaagttagatttgccactgttgccatagacttgatgggaggagttaaagtcatccttacatttagagttacagtttacatactaatgtagcatgtatatcaacacgttctcagaagaagagtaagaactaaaattagagaacaaatttttgatgacagggactatgatgtcaccattatgacattaacaaagttttgcaacatgttaatgctgtatttacagagagtctcccatgatttgagggactgtgattcattcaagcccagattatcattaaagcaaagcattgcagtttagacataactttatagagatccaagtgagtacttgaacatcctccaaaattcatatccaagatctggcacaaatttgtcagtgatgagttatgggccttcttggctccattacctaatgagtgctgtagaggaaatgtgtgtgtttacccactagagaaggaaaagtgccagctctggagcctgatggcaacactttccagagactgacttcagaaccacaatgccagtttgacttgatgctctttgcctgagtagcagtgggttttgagcagctttcatgccagacaaaaaacaactgttccttctgagactctgcaatcacaaaaatataacatagagcatcctctggaaagctagaaactcagaactgagatcatactaatttaaaggaaaatttatctgccaaaaagtatgaataatagacttgcattgtttatgaaacatagatactataataagatgagaaaataagatttaatggataaagaatttaatacaatggtgtactgatgtgaaatgaccaggagagcacaatagaattagcgttactaggcgtttcgttcgataatgatttacatttccaggatgaccaactgagccttagggatccaattttattattggactagaatgactagattaatttaatagacatttacctagatagcaatctaatagtatttggtcatagataatcattgggataccaatattatgagtaggatccatttatgcatagaatttttttgtttaaagaaatagtaatcattaaagaataacttttgaaattgtggcaaaagtttacaaacaaagacattattggattgatatttaattttagtgattgttttataatagaaataaatgtatgcagcttaataaaatactttataaaccttctgacaaatacatcacaaatatttttataatctaaccagaggcattcaatgcattatccaaacttgggatatcagcgtcacacttacaacaaaaatttagtatggattacagcaaatcttttactttctttacatactgctttcatgtttctcacaaaaactctatgaggcgtaaatggtcaaatattaatcctattttaacatgagaacaaattcagaaaagtcgtgttttaagttacatatatatgaagccaggcgatttatatatatatatatgtatatatatataaatataaaatttatcatttacatacacacacagtcaaattaatgccagtactgtaactttaatgagttctggggtaaccctgtttttatatactgctttcttcttatcttcttattgacttttcccactttcagtattttcactaattcaggttaacatttataacacatgtgatccgaatttccctgtgcctcacccatctatggatgtaatgagaccatatcaacagtgatgattcaattaatgtgacttctgctctccaccacatacaggccctctagtctcttctctataaagtcttaccatacttctgagccccttggaagtcacatacaagttctctaaatactaatgtcagtattattttactctggctgctgcactgacaattgatgtttgacagccacccaaattcagcatctctctaccacaagctctgggaccctaggggctcctgaagccacatatcatcatgtccctaaagcattatcccctatttttcacagccttctgaaatacttgatggtttcttagagacgtgggagaatgcctctctcctctaccttgtgttgtacttcatcattaaggcactaatacaactgatacaaagcttgcagttctttctcacacagagagcctcatacaaaacagctccttccaacagtcattctcttaaaagaactcaactgtaagattcttaaatcagactggaaaccaatgtccaatagacacaaatgggcttctacatcttgctttctctaatccactagttgcctgggaacaatacaaagctgtgaaactctcaggaatataaatttaaaccagcagatgcctttaggctggttcattagatgagttaagtctcaccagtagggataaacagactcaagctaggaccctccaccccaccccagtagatacagatgattcttctttttctccctttttcaacatacacttaggttaaaataagtagtcatgcataaattcctctttagtaatttaaattgtatttagttttatttttaatcaaaatcatgatattgtaaaagtattattaaagtaataaatgcttattgaaatttttttcaagttcatacatgactgtgtgaaaaataccacttttaactactgaaaaagaaatgctatttctttttatgaaagaaatttgtagtctttttttacaaagaacaaaatatatttgacaaagaaaaatgtagtacttttaaaatgaaatagacagtcctcataaggttttcaaactgtttaaagatgccttcaaattttttaaacagtaacaatgtgttacttgctgaatattgaaaggaatgaatacacagtcagattacctcagttagctaatgaaaatttattttaacatgatcatgaaagtaccgaaaagcagaaaatactttcattagcaacttttcaatactttaggaattgaaagttgcattagtaacctcatagcagctttgtagatgcacagcaagggaccaccccttagcagagctctgtctagtatgaagctagcttttttctgtcttagaatgtttctactgcttctgttctcccttttcctaatgactaacactcattgtgtccctaggcaaaaaagaccctagatgtgagcatatgactgtctagaacagtcaccagtaggtttcatttatcacagggaggtaaagtcctcatgccaggctccctggaaagcagcagaacagattgctattagtcaatcccatttggttctaatagtaagccactgatatggtttggctgtgtccccacccaaagctcatcttgaattgtagttcccataattcccaagggtcctgagagggatccggtgggaggtaattgaatcatgggggtggttcccccatgctattcttgtgataatgagtaagttttcacgagatctgatggttttataaggtgcttcccccttcacttggttctcattcttctctttcctgccactatgtgaagaaggatgtgtttgcttgccttccaaaatgattataagttttctgaggcctccctacccctgtggaactgtgagtcaattaaacctatttcctttgtaaattacccagtctcaggtatttcttcatagcaacatgagaacaaactaatacagtaaattgggtactgcagagagtggggagctgctgtaaagatacctgaaaatgtgaaagtgactttggaactgggtaataggcagaggttggaacagtttggagggctcagaagaggacaggagaatgtgggaaagtttggaacttcctagaagcttgttgaatggctttgaccaaaatgttatagtgatatgaacaatgaagtccaggctgagatggtctcatatggagatgaggaacttgtcaggaactggagtaaggtcactcttgctatgcaaagatactggcagcatttggcccttgccctagagatctatgaaactttgaacttgagagagatgatttagggtatctggcagaagaaatttataagtggccaagcattcaagaggaagcagagcattcaagtttgaaaatttgcagcctgatgatgtgatagaaaagaaaaacccattttctggagagatattcaagcctgctgcagaaaattgcataagtaacaaggagctgaatgttaatcaccaagacaatggggaaaatatctctagggcatgtcagagaccttcacggcaacccctcccatcacaaacctggaggcctaggaggaaaaagtgcttccctggaccaggctcagggcccccctgctctgtgcagtctcaggatatggtgccctatgtcccagctgtcttagctccagccatagctaaaaggggccaagatacaatgggggccattgcttcagagggtgcaagccccaagccttgccagcttccaggtcgtgtaggtcctgtggattctcagaagacaagaattgaggtttggaaaccttcacctagatttcataggatgtatggaaacacctggacatccaggcagaagtttgcagcatgggtggacccctcagggagatcctatgctagggctgtgcagaagggaaatgtagggttggagcccccacacagagtccccactagggcactgcctagtggagctgtgagaagagggccaccatcctccagaccctagaatggcagatccactgacagctttgcaccatgcacctggaaaacccacaggtactcaacaccaacctgtgaaagcactgaggaggggagctgtaccctgcaaagccgtagggtacagcccaaggctgtgggagctgctaaaggctgtgggagcccactcctgcatcagtatgaccttacatcagtgtgactccatgtgagtcatggaggcctgtggcccctctgttttggccaatttctcccatttggagtgggggtatttccccaatggctgtatccccattgtatctaggaagtaattaacttgcttttcattttgtaggctcataggcagaagggacttgccttgactcagatgaaaccttggacttggacttttgggataatgctagaatgagttgactttgggggactgttgaaaaggcacgattgtgttttaaaatgtgaggacatgagatttggttggggccaggagcataatgatatggttttgctgtgctcccacccaaatctcatcttgaattttaattcctataatccccacatgttgtgggagggaccccataagatctgatggtttgtaagaggcttcccccttcactcagttgtcattcttctctctccttgccaccacgtgcagaaggacatgtttgcttccccttccaccatgattgtaagtttcctgaagtctccccagcactgcagaattatgagtcaattaaacttccttcctttataaattacccagtctcaggtatttcctcatagtagcatgagaacagactgatacagccatggttaaaaaactttggccagaggaaaatgggaccttgataaaaaacagagcaagttttattttatgaatcactgttggtcattattcagaagggatcaataaacatatcagacacctggagcacactgcacaacttagtcaatttttattgccttctgattattctgaatacctagtacctctttttaaatacagacacattgggcccaggatgatgtgactaaagcttgtattagtcagggttgtccaaaaaaaataaaatcaacaggatgtgtatatatgtatatggagagatttattgtaagaaattggcttacatgattgtgagggtttggttaagtccaaaatctgatggtggaggttggcaggcaggagacccagggaagagttacagcttgagtttacaggtagtttggtggcagaattcctttttgcatagggaggttagtctttgtcttattaaagccttcgactgcttaaataaagcccacccacattaaagcaggtggggagtaatttgctttacccaaagtccaccaatttaaatgtcaatctcatcgaaaggaactctttcacaaaaacatccataataatgtttgagcatacattttagcactcgggttcagccaagttgacccataaaattaaccatcacaagtcttgaccaaacctgaacagattcagaagttaattctctgtgggccagggaaagcctgcatatcaggctggcacatcctgaataagtcagctaactcttccctacatctggtcctgagagatcactagcctttaaaatgatcaattctagggacagaggggcttcctactgatatccaataagtgacaaatgacttaatgacttctcaccaattcaggtattgctaccaagaaagaacaggtgaacctggattccaagagaaagcaaaactaagagcaaaaagcaacagaatattcacctcctgtagccaacagccagagagaggaatactagacgggcactcagaagagtttaaacctggtgaaacagaacttcaggagcatcgtgaagacacccctaacagagaccctaaccacaacagccaaaaagcatcctaaaagtatcaatgaaactataaaaaaagactctctggaactaaaaacgtggctttcgatttatagaatttatagcaagtatagaagcagatgatcactctggaaaaacaaattagtgtacaggaagattaagggtagaaatatgtcaaatcaatgcagaaatttagagacagaaattgtagacaggaaggttaaaactgaatagatgcatgaatctaaaataaaatgaaaaagagacaataattaagcaaatataaaaagaaagtataatggatatcaagaaagatttcagtccaaaggttgaaagcatgacaggaaatactgatttttaaaaagacacagcttagcagatgctagttaaatttttgagtttaggataaagtcatctttttcaaggctcttggcagaaataaattatgtgtaaaggaaagataatctggcattaaaatcttcatctacaactctgggaattaggagagaatgcatataccgttcaacatatccaaggttgagagacagaatatattacccacttacctcttctgaataaaatattctgcaaagaattctaaccaatgaaaaaataagtgagaataaaaatctgcaggatagggaaatttttttgaattgtgggctgtatatagctaaagataaagaaatttagataaagagaggatgggaaaagctttatattttctatagatatgcagtttttaagtaaaaatgatatattaaaggaaaagatgataatattaagagtttaaaatagcatgtcatcttatcatggatggagagcttttcagagtaagaatgttctaatggtcttttgtgaaacaaggctgaagtatgggaaagaggaagatttctcaatgtaacatcttcttagaagcagtgaagcagtgccacagtgggaggaagtccttggtaccttacgttcatgtaaaagtagagaaatgggcatatggttatgagtgccagaaataggatagcaatgaaagattaaggaaaaaaaaacactaaataatataaggaggggcatcatgtgctaataaaggaaaacacaacatttcctatgattttgaaaccacatcaagttggtaaaatccaacaatttttgatctacaaaagctgcacttttctgaaattcaagctaatatttatgctttgtatgatcataaaagtctaaaaagcgggatgataaaaagacagtttggtaataaaataataagcattattttattttttattacatgtaatcagaataaagatgttgtattttaaattttaaattaaaaatggcagtaaacaatgtaaacccgtcggatatgtcatagaatttggaaaaatgaagaaatcaatgtggggtagtgtgttcagagaaagcattccagtgaggaattaaattaagcctaaaaagatgactggaagaagagacattcctggattgggggtgagaaagatctaagcaaaaagaaggagaaacctgttttaaatgttgagatggattgtcgtaagaatgtcatgactgatgtaaagccaggggaatctcatagactagtaagatatttgactcccatattaaagtctgctttagattgagatagtccatttcacaatgacaatcatttagacaatctaaaaaggagaaatgacaatagtgtgtaagccctgctattcttttacacatagctaatactgaatagcaaccagtataatgggtggcatttctgaagtgagacatctcatgtcattctgcaagcttgtatgtgaccagaaggtcacattgtgatggtaatagacgttcacatcagttccttttctctgggactccaagagtataatataatcagcacatcaaatatatttcaaatatgtcattttcatgaagcatagttatcaatgaaatacatgtcactaaagaagattattttctggctttctttaaattgtttgttcatttgttttagaagctagcagagataattcctataggcattgaaatgaagatgtgtattattggtgaagagccctttaattatttgaatgagtttctgtttaatgaactcaggagtaaaacactaatgggcactaaaatatggttacacctgcagatcacctaactgaaaattttaaatggtctgtcacccaaagaaggtcagcaagtgcaattacaaaatacaggttaatcgaagaatcttactactactgatagtgtagagtttttgataagaaatcaacattctgctaaaaacggctactgttaatttacataggatcatagctgcattcacacagaaaggaattctacctcataatgaggaacctttcatttgtgctgaaaaatttcaagaatgagaagtgccaaaattagaacaactcacactaaaggaaaatgaatatgtatccctcaatataagtgaaacaaaaaagtagtgtatatgataaattagatattaataaagagggaggccatcttttaactcagttctgcctttgaaattctaatgatacaagtcgttttgctttgttttctgcacttgctttttgtcttgctacagaaaaccattttcctctcagcttttagaagtttaaacacacacacactccactcccacatatcacacacccatgcccacagactcatacacaggacctggaaatctttgcttttcattatccacttaacattgtcccctctttcataaagtgtaacattatgttttatgtatagaacaggagaataataagtcagaagaggagtaatgatcgtgtaaagagcttacagccaatttgttctacaagcttgcttttaaacagacatacattttagagtgtactggtttttagttccacaagagaagacataaatattatcaactccatgtaagtctggcacctgttaaattattcaaatggcttagtaattattaattaagatattgtctaatcttcaacttccattttaaactttccccctgtttcagatgggataatagggtatttgtatattcatttatgtgtttgttttcttgatcagctttggaagttattcggtcatttacaaaatttattaaattaaattataactaaaatggatggcagaaattcaaacacaatagaaatgaatttgttcatataagacatccccaaacagctgtgctgtaggggtttatgtccttaagggataattttttattttaaacaattgtttaatgtcacaagggactataatattcatttttcccagacagttggtatttgaattgcaaaaattctgcaaatacacaattatgctatctctgacaaaaatgcttagaatactgcttaatttagtcctcacttaattgatagccctccagtgcttcaaatcattagttaccgcaatgtggtttgtaggtttcattgacatttattttttaaatcactgtgctgagaagtagacagaaaaatcattggtagagcctgttcaattagttgaagaagctaaatgtaataatggtttcccaaaatatcaagtatagaaggtaaatatttttcaagtatgctgtttttgactatgggaaatcagtgcccctgacttgcaaatataccacaagttgggcctttactccaattaataactagtaacctctaaatgcttttaataagtattatctcttttctttctcttcttctttacttttctcttttggtgcatattatgatcttatttctactctcaataaatgtgtgcatatgtatattcatatacatagatatatacatgcatatagtgactacgttgaaaatatatacaccaaaccttagcagtgagtcaatctgaataatcatgggactacggattgtttttacttaattctgtgagctttgatattttttcagatgttctctaataactatattttattttcatactagaaatcataaatatactatatatgtattttaaattaaaaagagaatgtagctattaggaaatcagagtaggcaattaaaaagaaggaagaggggagaatgaacaatatccatttttaaactaatatttcagcatctgctattttcaggcattgtgttagtccagataattgtagtgcatatcttccagttctatgcatatcgcatatttgtgaaatatttttacaacatggaaatcataaggtatatgttgatttaaaaagtgcttttattttataatatgttatgcgcatttaaatatatgtttcacatctttctaaatcctcaatcttcatgaaaatcaccatcatcttcctgacttttcaagccaaaggtttgcccttaatttcattttttcttcttctgtttcgcctgtaaatccaatccagctgcaacaaccattgtctctacctgcaactacatagtaaatgtatacatttttcatctccattgataacactccagactccgtcattgttcacttgaaattctagaatagcctcctgtctcattttaaacctgcctctgtagtccattattttcaccatgaccagaaagatatattcaaaccatagctcaaactatgttagttcccccagttaaatcatttcaactgaacatgtaattggcgcaaatgtgtataaaatccaaacttcttaacctggctttaaaccttacaaaatctgaccttgcaatttctctgatctcctgttttacaattctccctttcccactcagaatgctaaattctagctgcatagacctgtgtcaattcctcaaactctgttctttcccaatttttgtctttccactgactcttttctctacccagaatattttccccagtcttcctatctgtcctatcttgttatccagcttctagccaaactgtcactatcatgttatttctcttcagagcacttgttgccacctgacacttttctaatagatgttaattaatagattgattagatagagtattgctttcttcacactagaacatactctctgtgaaggcagtgacccatttgcttcattcacctctatattcccagaggaaaaaaacttatgttctcatggtaaggttcagaaaaccttccaaagcacactctgttctgctatgttgcagaattagagttctgttccccttagccctgccagctcatgtacaattggtaagtagggaaatgacgtcagcataatgcaaaagtcatgtctgtctgttcacatttttttcctagaaaattaatattttaagtgaatagggcaagtttttcaaaattaaagataaagtctggacatatatgaagttcttacttaaatataatcctaaagcaatatctttattttgaaaaatggcttgtgtagtggcatcaaagattgctacactttgcactcattggctatctgaaagaatatagatgacacagctgtaaatatagtgctatctccctccaaacttaaaaatgattgattgaaaaatctacggtcctactcaatttttacctttcatgaaattggtctttattttagtgaatatctccaagcctgtacattttgaagaaggaagcatgagctgcaagactttagtcggccaggaattgattgttgctgcttgcaaatggttgcagcaatttaactgtggcaggaattttattaagaatattattctttgatttgtgctctagctacaaaattccataggttttgagtggtctttcacagtcctactttttcctatttattgagtaggtttgtagaaagcagaggtgtttagtaatggcatttcagcagaaatacttgaacttaatagtgctcatttgtgcaagattgactatgtttgaagttcagtacagggatatgaaaaagtaaaataataaaaaaggaaattaggtctttcatctgtctcattcagcctaaaatatataacctagctggaagctttcccttttagaatattgctacatattaatttacacaaaaggtatgcagagaagcctatctgatcatttagtaatatatgtactgttgatttcctaataagatcatgcctaacgtaaggtatcttcatatagtttatgctgtatccattcatatattcatttactcaacaaatatttactgatcaccaccactaccctaaccccagatccaggccgtgtgtaacattctcagtatttagtcaagaatgagagagtttctacctttaaggagctttaaagttgatattctataatcattttagctctgaatcaatgcactttccttgcctcgggaatatactggacaaaaagcatttcttaaatgtcttattgacttaatatatagctacttagtacatcttcattgggaagacttattttacactaagcctacaattatttgtgatgccaaatgcaaaatgtgtcttccctttatattgttgctttggggagtactgccttcactcctatgatttttcattagtatgttatttttataggttatttgttgtctttgcattctgaagttgcacacaaacacgtttaggtctagatatggttttatctgatcttcttcagattagcttgtgttcatatgtgagacaatgtttttcattagttgatgtgagaattatgtttttcattaattctgggaagccctcctacatcatcacttcaattactattgtcctccattcttttccttctgaaattccagtttatatatatcaggtctcatatagagaattataagttatttgaaatctgcttttaaattttcttctattttatttcagtagttttcagggaacaggtggtttttgtttacacagataagttctttagtagtgatttctgagattttggtgcacgcatcacctgaccagtgattgaacccaatgtgtagccttttatctctcacctccatcccatcattcctgttgtgtccccaatgtccattatatcattcttatgcctctgagtcctaataacttagctctcacttataagtgagaacatacaacatttgattttccatttctgagttacttcacttagaataatggtctccagctccatccaggatactgtgaatgccattatttcattcctttttatgactgaatagtattccatcatatatatatgccacatattctttatctacttgttggttgatgggcatttaaactggttccatatttttgcagttgtgaagtgagctactataaagatgattgtttatgtggcatatgtaagtcttttacatataacaacttcttttcttctgggtgggtacccaggagtcaatgactggatcaaatggtagttctacttttagtattttaaggaatctccgtactgttttccatagtgcttgtactagtttatattcccaccaacagtgtaaaagtgttctcttttcaccacatccatgccaatatctattattttaaattttttaaattatggccattcttgcaggagtaaagtgttatgtcattgtagttttaatttgcattaccctaatagttaatgatgttgagctttttttatgtttgtcggccattcgtatatcttctttagataattttctattcatgtcttttacccactttttgatgggattatttgttttttttttttcttgctgatttgttggagtgttttgtagattctggatattagtcctttgtcggatgcacagttcgtgaatattttctcccactctgtgggttatctgtttactctgctgattatttcttttgctatacagaagcttttgagtttaattaagttccatctatttatttttgtttttgttgtttgctgttggattcttggtcatgaactctttgcctaacccaatgtctagaagagtttttccaatgttatcatttagaatgtttatggtttcaggccttagatttaagtctttgatccatcttgagtagatttttgtataaggtgagagaggaggattgagtttcattcttctacatgtgctttgccaattatcacagcaccatttgttgactatggtatcctttccctaatttatgtttttgtttgctgtgtcaaaaatcagttggctgtaagtgtttgggtttatttctgggttctttattatgttccattagtccacttgcctatttttataccagtaccatgctattttggtaactataaccaaagtgatgtgaagcctccagatgtgttctttttgcttagtcttactttggctatgtgggcttttgccgttttttggttccatatgaattttaggattgttttttctagttctgtgaagaatgatgatggtactttgacgagaattgcattgaatctgtagattgcttttggcagtatggtcattttcacaatattgattctatccatccatgagcatggaatgtgttaccatttgtttgtgtcatctgtgatttctttcagcagtgttttgtagttttctgtgtagagatctttcacttccttggttaggtatattcctaagtattttaattatgtatttatttttgcagttattataaaagggattgagttcttgatttgattctcagcttggtagctgttggtgtatagcagtgctactgatttgtgtacattgattttgtatcctgaaattttactgaatttatttgtcagttctaggagctttttgaatgactctttatggacttctaggtatacaatcatatctttggcaaacagctacagtttgacttccattttattgatgtggatggctttgtttctttctcttgtctgattgctgtggctaggactttcagtactatgttgaatagaagtggtgaaagtgggaatccttgtcttgttccagttctcagggagaatgctttcaacttttccccattcagtataatgttggccatgggtttgtcttagatggcttttattaccttgaggtatgtcctttctatgctaattttgccaaaggttttaatcataaaggaaaactggagatttcaaatgttttctctgtgtttattaagataattatacaatttctgtttttaattctgtttatgtgatgtatcacaattattgacttgtgaatattaagccatccctgcatccctggtgtgaaatccacttgatcgtggtgtattatctttttgatatgctattggatttggttagctaatagctggttgaggatttttgcatctgtgttcatcaaggatattagtctgtagttttctttttttggtatgttctttcctgattgtggtattatattagattgacttgcttcatataatgaattagactggattccctttctctgtcttttagaatagcttcagtaagattggtaccagttcttctttgaatatctgatagaattcatttgtgaatcaatctggtcctggttttttttgttgttgacaatttttaaattacagttccaacctcactacttgttataggtctgttcatagtttctatttcttcctgatttaatctaggagggttgtatatttccaggaatttatccatctcctctagattttctagtttgtgcatgtaaaggcgttcacagtagccttgaatgatcttttgtatttctgtggtattggttgtaatagctcccattttgtttctcattgagactatttggatcttctccctttttttcttggttaatctcactaatgttcgatcacttttgattattttttcaaataaacagttttatgtttcatttgtcttgtatttttttgtttcaatttcatttagttctgctctgatctttattatttcttttctgctgggtttgtttttggtttattcttgtttctctaattccatgggatatgaccttagattgtctaattatgctctttcagactttttgatgtaggcaattaatgctatgaactttcctctgagcactccttttgctgtatttcaaaggttttgataatttgtgtcactgttatcattcagttcaaataatttttaaatttccatcttgatttcagtgttgacccaaagatcattcgagagcagattatttatgtataatctgctgttatgttaccataacctgctgttatgtatttcttgttttggggttccttttggagctgatttccaattttgttctactgtagtctgagagagtacttgatataattgtttttatcaaaaacaattttgtttttaatggcttgtttgtggcttatcatatggtcaatcttggagaatgttccatgtgcttaaaaagaaaatgtatatcttgcagttgttggatagaatgttctgtaaatatctgttaagtccatttgttctagggtatagtttaaatccagtgtgtcttcattgactttctgttttgattacctgtctgtgctatcagtgaagtcccccactataattgggttgccatctatctcatttcttaggtctagcagtaattgttttataaatttgggagctccagtgttaggtgcatatatatttaggattgtgatattttccatttgaattacttttttttatcattatataatttccttctttgtcttttctgtcattgctttaaagtctgtctgtctcatataagaatagctactcctactcacttttggtttctatttgtgtggaatatctttttccacccctttaccttaaatttatgtgagtcctgatgtgttaggtaagtttcttgaagacagcagataattgtttggtggatttttagccattctgccattctgtatcttttaaatggagcatttaggccatttaccttcagtgttagtattgagatgtgaagtactgttctattatcatgccaaatgctgcctaaatatcttggtttttgtgtgtattgttttatagaccctgtgagatttatgttttaaggaggttctattttgatctattttgatgttttgtttcaggatttagagctccttttagcatttcttgtagtgctggcttagtagtggcaaattttctcagcatttgtttgtctgaaaaaagttttatctctccttcatttattaagtttagtttgctagatacaaaattcttggctgacaattttttttgtttcaggaggctaaagataggaccccaatcccttctggctcgtaagatttctgctgagaaatctgctgttaatctaaaggttttcttgtataagttacctgaatcttttgtctcacagctcctaagattgtttccttcatcttgattttagataacctgatgaccatatgtctagatgatgatctattagcaatgaatttcccagccgttctttgagcttcttttatttggatgtctaaatctctagcaaggccagggaagttttcctcaattattccctcaaataagttttacaaacttttagatttctcttcttcctcagagcaccatttattcttagttttagtgatttaacataatcccagttttcttggatggtttgtttactttttaaaatttattttctttgtctttgtcttattgggttgatttgaaagccttgtttctgaactctgaagttgtttttcctacttgttctggtctattttttaaactttccagtgcagtttgcatttttctaagtgtgtctttcatttccagaggttgtgagtgatttttctttatatctatcgcttttgagaactttcatccatatcctgtatttttttaaatttaagttggctttcacctttttatgatatctccttgagtagctactttttaaattgatttacttaaatttaaattttgatgagaatttctaattctagaagttctatttttccccaatatttctgatttatatctatatatagtctttctttctcacatttaaatttcttagtcaaaataatgctaataattttttattttcttattttaaagtttctgttgaataattatgttaattgaatttcctttgagtttaatcctggtggggtggggtgaggaaatgtatgtacataagtatgtgtacatgcaggtaccctgactcttctcatggtggaatggttcttcatgtattttgtagttttgggttgtgagttgttgattggttgggctttgtctatgggaatcttatgaaatgtatattaaaatatatatgtctccagatgtatcttagctttgtttctatagagatctccaggagtattactaatatcactacattttttatgttattttttggcagctgggggggtgtggatttctcagtctatgcaggaaatataaacaggaatccaactaagacagagataaagaaggcctgggaatgtgaatatcaaggaagacaacttttgtcccaacaatatccaagaataagaccaacaaatacgtaggaagatattttattcaccttctccttttctcagaaatgttcactctatatgggtcttaacttcatgcagtaatctcatttctacttccattttcttgagcctgatgtctcatatgctgtttaaaacttatctacacattacccaaccaccctaacaataactacagaagcttctcagtttcctcatatttgtcccttagggttttggcaacattaaaactaacattttggtaacattttaaataaggttggcataatatattccaaatatatatatatatatatttatacttatatttatatatttatatattatatttatatttaaataaggttggcataatatatgccaaatatatatatatatatatatatatatatatatatatatttggcatatatatacacatataatatatttggcatatattatatgtgtatatacgtataagtgtgtatgtatgtatgtgtatatatatatataattggaacagttttcatattatctagtctgatatatggcttcacatcatttatacagaatgatgtttatctatcccagtaattataataatagaaataatttacctgtattcatgagctttatcctaactatctactggatatactagctatctcacttttctttttcttcttttttttttcttgaaaagctgcatagttttcttggctttgtcaaatttatacagtgcaaccacaaaagagatggaggctacaactctgattatcacctaaaatttagttgcagtgtccaaacagaagaataatgccaaaaagctggtattgttgttagtgataattcttacttattgtttcttgagaataagaaaatgctacttttaggggttttcaaaaaataaataaataaaaacaatttcttaagcaccttgctggtcctgaaaggtgcttcaatttgctacaattttaatagttgagaaggggatggtaatctaagctggatttcaaggcgcaaccgtgagtctggaattggttatcaacagagatgagggcaaaccagagacgtattacaaagtaaggttacaaaatagtcatggaatttgacaagcaattaaccctccatgttatgttgcttattgagtcaataactattccaaaagagaagggagccttgtaataacaactccaagttagcttccagctttcaaatttgcctgagagcctaaggtaaaaaatgaaagactagacaaagcatttcattgggttgtcagtctacgacatcaatcaaaatattaaagattcatcatgtacaaaatattgagtacagtttgcaggtaggttaggaattcatcttcaggttctcttggttcactcaattgatctaagacctaagaaagaaagctcttattgtcaccaatcagaaatctttatgatatattatctaagattcataatctgtagaagctcttccaaagaaagagatctcctttttcccaaaccgtgaacaaagatacaaatacttagtgttcttatgcataatagcatacaaaagcagatattttagaataaaatgggaaattttccttcttttgtttataaagaacaactattatatagattaatcaaacatagtatattaatctcttgttctccgataagaggatattagagtatattggagactgttgtgatttacagctcaaaactggaaaaaaaaagtttgatatataaagaaacctaaagcttatatattcttgcatattattctccacattaaaatttattttctgctgtttctcattcatggctacactttatgatcattttcaagaacttaacaaatagtgaaaaactgcgtactgctccacttcagaatgttaagtcagaacttctgagagtggagcccaagaattggaatgattataaaagttccatcagataattttactatgtaactagattaagaactagggagaacttactgtggttgtgagctggacaccacagccctgaagcctgagcaggagcagtgaaaggagggggtttaccatatcatcgcaagctgagaggaaggctgttgggggatacatgcagctggaggaagaatgcttagggcatacgtgtagcttgtttgttctttacaaagcatttgggagatttgccctgaggtaattaatgcttcaagttacagttacattggttttgaattccctcaggtttacctcttagaagcagctgaaggtgcagtttatacagtaagttgattctacttatatttcagcaacttaaaaattggttacaaagtagacaatatttataactaggttaaataattcttattatgttttaacttatgtaaaataactataaaacattgtagctataaaacatttattaaaatacacgaaagtacattaagtactagtttacctacaatcaagtattgcctgctttctaataccagtaaaaacattatcaccctaaacaataaaaatgatttttttcatccctttccctacagatatttttaaaggttaattagctatttccatttttatggcattttgagacttttaaatgctttccatttctgaggttattccattaatctaaacccaaatagtgaacactgtgatcttggtctctctttctgtgtctctttctgtctctatgtctctcttctcatcaactgagtcagcaatccccaaattataaactatgttgtctgagatatttgttaacatgcacatccctgaagcttggttccaggaattttgattgagtatatagaagatggggtccggggaatttttattttaacagtactccagttaatttcaattcagttgtcccttggatgacagtgaaaaatagaaaacagtgatagaaaacaatgatattcattgcttcaggtaataagcctttttatgttctgtattgtgtaatatggctaaaaatacaaacatggatgagaaattgaccctgccttcaaatagacttgtttgtttaatatgattgatggttacaaatgctataacagagctacatatacatttctaagggaatgtaatgagagcaggaaaggattcttctaggaagtaccatttgtgtacagtcatgaaaagtgaagtagatttaaggagaatcttctaggtaaataaaacagtaaaagcacaggctcaggcacaagactgtccagagtttgtagaggaaatagtgcataggttttattgaacaacaagtgttaccagtgtaagggcccaattttcagtaatttttattggttcttttaggactctggaataacttaaaagtttacatctaattttttctcagagaatcatggaagcgtctattgatgtaattggtgtctctagcaccaagggagctagaatctatttctttcctacctgccaaagagacactgtgaataaggttaacaaatgaaaaaaaatttctaatactacctcagcctggttcctctcatgtgttccttgaaagactctacatcttgagacatttaaatcaaccaacctagctctcctatttctcccctttgttcaaaaagaaattaagacagtggggcatatttttttctcctatgtgtagccttgttcttggaagtatatgaattccaagcaaaactacatctaaacattagtggatgaacaaaatgagctactgaaaggcatttggaaaaaatggcactctaacacaaagtaataaagaatacagtagagcaagatgttacttttctgtttctgtaattatgctgacaccaacatatgcagttgttgagactttaagggtcatattaccttctggtaatttattaatgaccttttcttagggattagaaaaactagcagaatccaaatatctggatatgcaattctaaagatttatgccccaatgaattccatgtgagaaaacaatttgaattaaaagagtttactcttaaatcttcaaattatactacacaataagtctgctatgttattgccaaatatatcaaatcctacattctgtttaatcttttggaacctatcacaagttggtttatctgggaagctgactgagagaaagattggcatgcaggaggtttattatggaatgctcttgggatcaccacatgtgaataagaaggaaaagaaacaggattgggaagagcagaaagttgggctgctgtgtaatctcagcaaaaggttcacacaggccaactgtagctgagataatccttcagtgtcgtcacttgctaaagcaagggaattgggcttttatgccacaggtggaccagtagttggatgcaggtggcctccgcctagactcttgacctgggcaaagcacttctcttcagcaaaggcaattcccaactagggctgagagctgagtgctctctgtagctaatacctttcgcagttggggaaacaaatctgaactcttgtgtcccaccaaaactcacatgtggaagccctaacacccagtgtgaagtctctggaggagaggcccttgggaagtaattaggtttagatgaaatcgtaagggtggggcctcataatggaattagaacctttagaagaaaaggaagaaacaggagctcatgctctccctcttccatgtgagaacacagcaaaaaggcgacttctacaacccaggaaaatggcactcaccaagaaaccaaattggctagcagttcaatcttaatcttcacagtctttagaactgtgagaaataaattcctgtttgtaaagccaaccagtctatggtattttgttatagcagcccaagttgactaagaggaagccctttagtcagaaagggagatgagcgtggcccatcacatctctgtggtagccacatattttctcctccaagcaacaactggtgggtgctccgccatggccagacttgttactaaatctggagcctgaccagtaaaaataaattgcctgctcacctacaccaagccactgctttggattatacattacaacagagcaagtctaggcagagagacgtcttgagattcatgtccactccactatccttccttgaatcctgtggaatatggagagaataaaaaaaattctcctacacaataaggcacggaggttaggtaaaaatcaagatatggcatccttaaaggataaggaataaggagtgaggggacccacagcacagaatgagcttgccagaaaaagcactgcacttctgcactttgctgatgctgaaagaatagatggcaagttattccagcagtgaccacggcaaatagggtcccagaccctaccccttccctccaatgtcaggaagatatggaagcagttgagagcctagatcatactgggaaagagacacaggagagaagccttgaaattaacagagtttatccagaagatacagctttaaactggaagttaccttgatttagaaagactcttttccattatagaggaagtcaatctttggaatacataagtttgtttaaacaggaataacaaatgttacatttttacaaatctgagtcctgtttttatgcattctctctctctctctctctttaatttttttatttttttttattttttgagacagagtttcactttgtcgcccaggctggagtgaggtggcacaatttcggctcactgcaacctctgcctcctgggttcaagagattctcctgcctcagcctcctgagtagctgagattatgggtgcctgccaccatggccagctaattttttgtattatttttagtagagacggtttcgccatgttggccagagctcaagtaatccgcccacctcggcctcccaaagtgctgggattacaggtatgagccaccatgcctagcctacatatttctcttgtatcagattttaaatacttataaaagtgaataaaaagaataaattgccagattatctcaccattatttttctatccatattagcttctgctgatttccactccttttacttctctgtccactgtgtgtgtgtgtgtgtatgtgtgtgtgtgtatatgtgtgtgtgttacaggttctaatgcatccatattctttaagcactcccattttatttctaccaattgtatgtttttttcattcagtaatatattcaaaatgtgtaagtccaattcttttcttagaaaatttaattgaccattctggaaactaagattcaagaagtgatacagtcctcttttagcctagtcttatattcataaagcagattggtttttcaacataggctagtgtgtatgtattctggggacctaagccaggtacacctcatctatcttggcttgttcaatacacatgatggctacagactgtaccatacagtgcatgcaggcatgcacacagccctcatttatcacctacggcttctctgccctgacagaacctgggacaagcactttcgtagactcagagctgtgggaataggagaaggttcaattactcatatggtgcttggaatcctgccaaagacagttaaactagctatgccactatgaggcttatactttcttgataggtaggtagatgatagatagatagatagatagatgatagatagtagatagataatctctagatatagagctgtctatagatatataaaggtattgttattttaaaagtaaaaactcaaaacattagaattaaaacaggataatcagattatttcctccaagaaaatcaaacaaaacaaaacatgtaactagtatattcaaagaattgtttgccatttattcagattttattgaaataaaatatattcttttaaaatatttctctacactactaatatagatgtcccatagataaagacccagacagtctgaagtagtttttaaaggatttctcatgtttcagggaagatttgactaggagacaaatgaagtgcttttcaattctaactctataatcccatgaaatgcagacatcaaatataagaaattgtcataatggaatttcagttgttaaaatatctttacatgttataaaaatgctattttgacatatatacgttgcctcaccagaaattattctgatgcttaagggattagaaatataaaatgtcattgtgattaaatgtattaactgctatagaagaatatatgtaaattcaagaaatgtccattctttatgtatgtatatatgtttacatatagacacacacatagagatgcatttcatacatacacacatacatatggatatgtacacacatatatacaaacatgcatacatatacatacatatatatatagtttgatctttgcctacgtgcatacttatatatacaaacatacatgtgatgtgcatatgtgtgtataaacttctgagtacatatatatgcacagatatgtgcacacctatgcatatatgtgcatttataggtttatatatacacacctatatataggtctatatgtgtatatttattcatttatgtaatgcatatattgaagtatgtatgcattaaatatacattatgcatacacatgaaatacaaatgtgtaattatataaatatgcatatatacatatatgcacatgcataaacatatatagccatacacacatacagagataacaaacagatatgcatgatgaaagaaactaagcatcctctaaagggaaaatgtaataaagaaagtgcattaattatttatgatccgtttcataatttaatacttgtaaattttgtgtttgcttttttgaaatattatattagagaagatagggccatcataaatatatatatatatatttttttttatgagatggagtctcactctattgcccatgctggagtgcagtggcatgaccttggctcactgcaacctccgcctcccaggttcaagtgattctcctgcttcagcctcccgagtagttgggactacaggtatgcgccaccacgcccagataatttttttgtatttttggtagagatgaggttttgccatgttggccatgctgctttcaaactcctgacctcaggtggtctgctcacctcagcctcccaaattgctgggattacaggtgtgagccactgcacccggccccatggccatcatagtttaatgaggataatatatattagtacagtcatgctttgcttaactgtggagctatgttctgaaaaatgtgtcattaggctattttgttgttgtgagaacatcatagagcatattcacaagtctagatggtatagcgcactacacacctaggccatacaatatacctattgctcctaggttacaaacctatacagaaagttactgtactgaatactgtaggcaactataacatgatgatgtttgtggatataaacatgtctaaacacagaaaagctacagtaaaagacgacactataatctgatgggaccactgttgtctgtgcagtaggtagtccaaaatggtttgtggtgtatgactgcatttctttcagtatgcttcctttcttgatactgtctcatttgtaaataaatgtgtagaaaattatacctataaactttatgttctagaagaaaatttcttccaaaagatatatttcgaatggaaaaatgtgcttcacaaattagagaaaaaccaatatatgtaagaaatatcataagagcatgtgaaaataatactatttttatgttcctcctgaggtaaatttgcatatattcttctataatgtaagaaagaagggaggaggtgagagaaaaggaaggaaaagagaagggaagaagagagatttgtcaatacaaataagttggagaagaagtatttgctgcatattcttattaagaactaaaacactttttaggaacacagaatatctaaggacttttttgcttttattctttatttaaaaaatgaataacatagatccctctaagaaactgtttaaactaatgttccttatcctcaaacacatataattatctaaggcaatagcctatggataggaaaggaaaatacatattataaatcccatttgcaccttagaataaacaggcaaagtccatgcatttcaacaaatatttttaaaaaatataatatatgtttgaagctgtactaagtagctatgcaaaccacagatacaatagtgtgtgcatcgtgcattttcagtgggggccataccacccccaagtaggcaaaaatcggttggcaaagtgagtcaaagctctgactcatttttttgtgtaaatatgtatgcaatgccatgactagatatacagaacttctgtagcactaagatttcattggtggaggggcagtcggaaaaagaaaattttaaagtctcttctagggcatgacaatagaaataataattaatgctgagaaacactggtgcacataatacaatggaaacagaaaagagaagcagggtaggaaagtcagacagacttcctcaaggagctgaatgagagttctttcaacagataggtagagttagctaggaggagttgcagcagggaggataaagtaaatcaattataaggaaagaacagcaatgcagtcattggagatatgaaacgagagtgacctgtgcagagagctgtaaggcaaactagtgggaccgaagggtggattagcaggacaacaagatattgaagatgtgtatggtttaagcagcttgagcttctcccgtgggcaaagaaaagaaggcattggtgacctttcagctgatggcacccaatttgcattttaagcagacttgctacagaagcaagagaagcagtcaggagactgtacacatggtgatgacatgcaggtctacttcttttatccataattccaaaatcaaaaatggtctgaaaaccaaaaaatttttgtaactgacctgaacgtatatgaacctatttatacttttggtttttctcattatgtagaaaatcgtttcattataaacatattaatgtatcctattatggatttgattatgccctggaacaatctgacagtgttacttaattcacagtatcatgcactaaaatttctaaaatgtaaaaaaagagacaaagagacaaaacttaactgtgaaactttaagtgcttgcaatattggataagaccttgtaaacctagaacaacctgtcttgagagtttatgcctagactatttaaatgatttacacattttatatttcatactttacaacaagtttctaaggtagttatagttacctctatctggtatctttaaaaaaattaaaacttgaagaatttaagtaaattgcccacagcaaacatatagaatcagacaatccgtagagcatcggtttgacttcaaagttcatgttcattatctgagtatacgttaggacaaagataattaatgggtggttgttcatatctttctctctactcatcccagagcatcagagtgtttgatctatctcctccaagccctcatggagaataaaatgattgaaagaggctcaaatataaatatgtggccgagatggccttgcttggaagattaaaggaaagaatacaggagtagctacagattcatggacttttgtttactgtcaattgcaacagattgtttcttaagaattttcagaattcatagccattattctttactcaagaataaaagtgaattactttttctaggcagaaaccttcttaatgccttacattttcatgtcagatcaaaggtttcaaaatgaggcctaacagtcttttcaatcctggtgtcatttttcagtaaaagaagctagaagtaacaatgttgaatcttttacatttgtgtaaaaaccgtagtaaaattgagattacctgggtgtcctgtggtatttttccacaagctaattaaagtattgattgaattatttcttcctggaaggtgtgcgaaaggtctggtcatgacattttcccagaacagatctattaaactgaggaatatagttagactggcaggctatattttctgcattccttttttctctgccttttgagagttacaaataagtgctgacctataaacctaaggacaaaagaaatgttgatgttttgacaattagaaacatcaaatgatgtttgacaagtatatcaaatgaaatcaggtaacagattaataaatcatttcttcgttatttactgaaatcttagatctgtggtatcatgtaggtaaataatttattcttaccatgtagaatcacattgcagagtatttgttaagaatatgtctttgtagctggactacccagcttgaattctggttcattcacttattaactgggtgaacttgagaaagtcacttaacacctgtacttcagtttctaagaatgaaaaatagaaataatgatagtacctaccttaggggtttttatggaatccaatcaattaatacatgtaaagcattaaagctgccatctaataagtgctcaaagttagcttttaacaattatgattacttattaaaaggctttctatattagtagacaacagagaagaataaaaagaagagactatagttaagatcattagctgggtgcagtggctcacgcctgtaatcccagcactttgggaggctgaggcatgagatcacttgaggtcaaaagttggacaccagcctggccaacatggtgaaaccccgtctctattataaatacaaaaattagccaggtgtggtggtgcatacctgtaattccagctactcgtgtggctgaggcaggagaatctcttgaacccaggaggcagaggttgcagtgagccaagtttgtgccgctgcactccagccaggacaacacagtgagactctgtcccccaccaaaaaatagatcatagttctgcttcacatggtttccactttggtagagatgttaattgcttaatgcaatagttataatatttttaaacttctttatcttctttcacatcacactatggagcctaaaaaagtaagacaataatttccaagattgtcttgcagctaggcatggccatgggaagttatggccattgaactgaaaagtcaaggctggtgggtcttcacagaaaagatttttatctccgaagaagaaacatgtacttgttttatatcttccttacatgaatgtggacatgtttcctggagccacggcagtcattctgttaccatgaggtgaccagcataaagacaagaagataatagatcaataagacactgaataatcccagcatgactgaggtcttggtagcattgtaaggacctgaatcaatgccaaggattatctaactattgcttttttagtatttgaagaaagtgaactattttaaaattcattctactgcccagcacttaacattcatcaatgatatgatgccatgtttctaaccctgtaatcttaaaaattgctcaacctgcatgaactgaagttttcttgtagtggaggggtgtaatgccaccagcaccacaatttggtgataaagaggaaacgaaaagttaccactgtaattgttgctgcaatgatcactttaacttttttttttcaatcacacaaccaactaggttgtgtttgtatttgcctgtgttacactatatgctgattttaaaacaaaattaattgtggggttttttttagagacactataaagtccttttattcaggtagtaagatattatcatgcagtatatttcaagtggtcccaatcacctagatgattaatttagatagtaaaatgtatttaaaatatagattatttttaaaaacatgccattttattaatttaatggactattttattaatttaatggactatttatagcctcatcttaattgagttcagctgggtttgatagttttgaccattatatcttgaaacgctccttttccttatattgacatacttggattttttctttcttctgttcactctgaatctctgtttttgacacctctttgtctatctcttaaatgttgatactacttagtcatctttcctttaaactttattttctttacctgatggctgttgctcaccattcttcctcagggcatttacacaaactaaaaagagcaatatttatactcagtgaggagtggaagaagaacgtggattcatagttcctaaggcttgaaaataaaaaatgcaaaaaaaaaaatacttcgcaacagtgggagtttctatgacatcctgcctgcaggatcccatttaatgggttgacgctgttgttacctgtgcccggagctgtcttaacactgggtctgttgttatggaagcaggttcaatcttagcaacagttggcagcccccaaaagtgttttacttaattttttcctgaatattagagaaaaaataataaccaataaatgaaaaacaaaccgtggaataatctagagtcaataggtaagcaccctttgtttcacgtaattcaaccttggaggggaaatggaaagtcaaaaattgataactatttttgttccataataacattacgaacaattaattcagccaagtctctttgcataattttccacactgacatatgttaatgtttgctctgtatggctgcacctgcctagagcaaagtcagtgtgatatttggtttgtttctttggtaatttcttactttctgaaagtgaaaaaatggaattctacccttgaatgtagtggttttgttaaaccctacttatacatgctgcttttatcagccttcattaatttttaacatatttcattctagaaatgcaaatccagaatatgttaagcttttctaattgtaaatgggatatatgtacataattaaaacacaaagaagagtagtagatttataacacattaaaacatataactcaatatgactttctccctttctcagtttgccagaggtaacactcttacctctttactgctgctgcaatttctctctatattttaaaaataattagtgagtacttctatctcattcattgatttatattatcatctattaacttcctattattgcagatgagaattttatctcttatgtcctttcttcccatttctccacatttctactttatttttaatcacactttcccattattgtacttatttaagttttttaagttgagccaaaatgtttaataagatatttctttgtttatgaacctttgtgttggacctgggcttaaaaagcacgccttttgtttttcatttgtgtagttttctttgcatctctggctaagtcttcacatattcattccaataactataaattgcccataaaaacagctttaaaatatctatcctgtctgataatctatttgttcctgccattttccttactgggacctcccattccaatttgatctgattatcctgtaaacctactgtttcatcctgggtcccctcctggtcatcatcctgggcttccctttccctgtatcatctgtagatcagttgtttctggatcctgtgttatccttttggatttactcctaaatttctgttagagaaattttccagtaacttcctgagaaggagcatagaaaaaatacattttaaagttttgcctgaaaaaatgtatatttcaatattcatattgatcgataactattctagatatagaattccatgtttcaaaaaaattaagaactccaaatagccagaacaattttgaaactgaaaaagaattgaaggttttatctttcctaatttcaaaacttatgacaaatctgctgtaatcaaacagcgtggtattggcataaaaacagacacaggccaatggactgcaatagagtccagaaatacactatcacatatatggccaaatgattttcaacaagggtgccaagagtattcagtggggaaaaggacagtctttttaacaaatggttttgggaaaattggatatccactgcaaaagaatgaagttggacccatactttgcaccatatataaaaattaactcaaaatatatcaaagacttaaatgtaagacctaaagctataaaactcttagaaaacaacataggagaaaagtttcatgacactggattttgcagcaatttcttgaatatgacaccaaaagcacaggcaacaaaagaaaaaaataggtaaattggactacatcaaaattataaacttctgtggatcaaaggacaccatcaaagtgaaaaggtaaccattgaaatgggagaaaatatttctcaatcaaatatctgataaggcattattacctagaacatataaagatttgctacaactcaacaacaacaaaataacctagttaaaaatgaataaatgacttcaatagacattttttccaaagcagatatacaaaatatcaataagcatacaaaaatatgttctacatcactaatcatcagggaaatacaaaccaaaactacaataaaatatcatctcacaccccttaggatgtttactattaaaaagtaaaacagaaagtaacaggtgttggtgaagatgaagatatattggatttttgtgcactgccctgttgctgggaatgtaaaatggtgcaatcactaggcaaaacagtatggcagtacctaaaataaattaaaaatagaatgcaattgctatataacctaacaattccacttctgaatataaacaagagaattgaaagcagggtcttgaaaagatatttgtatacccatgttcatggtagcattattcacaatagccaagagttgtggaagcaataaaaatatccatgaaaggataaatgtattaaaaaattgtagactatccacacaatagaatactattcagccttatgaggaacccacgtcctgtcacatgctacattatggatataatttgagtatattttgctaagtgaaacaagccgatcacaaagacaaataacgtatgaacctgctccacctatattacatatctggagtagttaaattcacaaaaacagaaagcagaatagtaattgtcaggtactaggggagaaagaaatgcagagttgttatttaacaggtacagagtttttgttttgcaagaagaaaaagcttttgagctctgttgtgcaacaacccaaacatatttatcactaattagctatatccttaaaaatgcttaagatggtaaattttacagtatatgtattttaccacaagtaatttttttaatgaaaacaaaattctgaagacaatacttagggagttgagacagaaaccaatggaagaactttccccagccccaggagggaacattcacaaggtgggccttatgttgtttccaaatcactgtagacataggactctttaggatctccttttcttttatttttcaaatgtacatgtacattgaatcttgccttttttattatacagttggtatagagaaatttttttaaaattttattatttctttaatccttgagcagtcacatctagacctttgaaccatccagagttcaagactgtaaataattatttaattatatatatacttttaaaagttaccattcaacacagtttcctagattttaaatgtaagtttttgcatcattagatcaaaatactttataatcaatatctgtcgattaaagtaacaattaatataaggactttattgcaagagttctacatggatacaagtacacatatacaccaaccataaactgaaaacaaaactatgtaataatattcaaataaattccatgtaaattatatttctgtattagttttctattgctactgtaacaacttatcacaaacttagtgccttaaagcaatgcaaattctggcccgcacggtggctcacgcctgtaatcccagcactttgggaggccaaggtgggtggatcacgaggtcaggagatcaagaccatcctggctaacgtggtgaaaccccatctctactaaaaaatacaaaaaaaaaaaaaattagccgggcgtggtggcgagtgcctgtagtccctgctacttaggaggctgaggcaggagaatggcatgaacctgggaggcggagcttgcaatgaaccgagatcgcaccactgcacactccagtctggaccacagagtgagactccgtctcaaaaaaaacaaaaaagcaatgcaaattcattaccttacagttccggaagtgagaagtccaaaatggatcagcagcgctgcatttcatctgaaggctctagaggaaaatgtatgttgcttttcctagctcctagagactgcctccattctttgccttatggctctacattactcccacctctgctttagttgtcacatcctctgagtttcttgacttcctatttctcttataaaagaccctgttgaccaggcgtgatgttcacgcctgtaatccgagcactttgggaggccaaggcagtcggatcacttgaggtcaggagttcaagaccagcctggcaaacatggtgaaaccctgtctctactaaaaaaaaatacaaaaaaaagaaaaaaaattagccaggcattgtggtgcacgcctgtaatcccagctacttgggagactgaggcaggagaatcgtttgaacccaggaggaggaggttgcagtgagccaagatcgctccactgcactccagcctgggcgtcagagtgagaccttgtcaaaacaaacaaacaaacaaacaaacctgtgattgtcttgctctcacctgaataattcagaataatctcatctcaaaattcttaatttaatcacatctgcgaatttctttttgccatgtaaggtaacatattcacagattcctggcattggggcatggacatctttgggggccattattagattgtttctaaacaactaaatcttgtgttgcttttttttttaatgtagcattattgtggccttaattgactgatagaatacctttttaactttaattaaaattgtcataaaattgaattttaaaatgacacaaaaagtactggctacaaagaaaaatattgataaactgaattacaatataattaaagcttctgttcatcaaaatgtattgagtgaaaatacatcatactaactaaatacaactgacacggggacttattcacagtatattttaggaactcctacaaatcagtatgaaaacaatagataatcccagagaaaatagtctagagatttaagcaagactttccctaaggagatattcagatatccacgtacgtatgaacattgctatgcttcatcagccatcagggcaaagcaaagtaaaaccccaacaagatacaaccatccacccacccaaaggactaaaatagactgaaaatttacatgctacccagattatcatagcgtactagtggcaagaaattgctacaagcactttggaaaacagtttagcaatatgttataaattgggggaaagactgtctacttgagaaacagagcagaggccggtataggtaaacatcctgaggtaaggagagactagtatgagaagaatttgagtacagacaccatgctaagcaaaaccttttaggatgtggtaaataaaatgcagttttcattgtaagtgcaatggaaagacacattgttatgtgtggagaatgagttgaaatggggcaaaaaaaaaaaaaagcaaaatgactagttagtaggattatgttagaaatcagtaactaaaaggattagggtgatggcgatggaactgcaaagaagcaagtggattcaaaatgtattttggaggcgtaatcaaatgaataaaaggttatgtggaagccagggtttgtaagacaaagaaacaaaaacaaacaggagaaaggaagatgtttcctaatttctctggctgagcgatttggtgcatgatacggtttattcatttcttaagacaaggaagaaattaagtgaacttctaggaggttttgcctttctactttgacagattgaattttgtttctctttgctctacatttcttaccctgccatgcatcattgggatctggtttaatgaggggcatgttaaggagaaaatagcatggaccataagtagataatccaacatctctgcgatcaacacttctaagagttcagaatacagataggaatttcatttcttcacacttctctgtaaacacatgagtgagacaaagaatttgtctccattactaatcacctcacgaggaagtgtgttatagaagaatagtaaagatgttaaaagaaatcaaactgtataatacgggtaataaagattttgctttggatttttatttaatttgtgctttaactgaattgttcaggaaaaaattagatgtactaataataggtttaatgtaaaatgtactaatttcttagaaaataagtaatatgtcatatgagaaaatagcagttaattattacagtgacttttattttactttgttgagacaataattgtcttcatagtctatctgggaaatgtacactgttaattattatctcattttcctaaacagaaggatgctaaattagtgattttaacagaagtagaaactagcacaaagcaatgtattatttaatatttcttgaattttatttgctatgctcaaaagtatttggtcaggataatttggcagatcaatttaatgctaataataattaatattaaaaagaggacagactgaatataatgccatatttctaatggaaatgtattaaaaattcaggcaaaatattgaatgtaaataatttggattacaacttccaagttaattatcacaaaagaaatgttagcttttcacctattacacattttattacaatattttagaccattcatcaccttcaagagaatgtctgcacttcatttttataatttatagtgactaaaatgtgagaaaatactgattttcagatcagtgaataatttaaataaattaacgtataaactaaaatctaattttagttcttaccagcccctttttcttgactctttcatggtctaaatcaatctttggaaaatatgagtgaaggtggaatttgaaatgctaaatttgctataaaaatgtcattcacctatcctccaggattcttcattaaaaagaagcagtctaggcactttgctttatttctaactattattgaggtaaaaatagaaaaaaaataggctaagaattcatatcagtgcaattaatcttttacaactaccttaccctatttttgcaatagttaaggcagaaactagagattttaatgatttcttactttttttcacatacatttaaggagtacaagctcaattttgtcacatgggcatattgcatagtggtgaagtcttagttttagtgtatccatcacctgaattatttaccatccaccccccacacacaccatgtgcaccccaccacaccatgtgcacccccctgcacctaccttctgagtctccaatgcttattacttcacattctatggccaaatcccatttacccactgttgtttttgttgcttgtgctcttatggtcttagtcatgaatctttgcctggactattgagtcttcattaaatttctctagggtttcttctagtatttttgtatttttaggtcttacacttaagtctttcatccattttgtgttgatttttgtgtatggtgagagatttgggtctgttttcagtcttttgcatgtggctatctaattttcacagtaccacttattgaaaaggatttcctttccccagtgtatgtccttgctgactctgccaaagatcagctggctgtggatatgtggctttacttctgggttctctattctgttccattggtctatatatctgtttttatgccagtaccacacaatatgatgcctctagctttgtgcttttggcttaggattactttggttatttggtctctttctggttccatatgaattttaggattgcttattctaattctttgaaaaatgatattggtattttaatagggattgcagtagatctgaaattgctttgcatagtatggtcattgtaataatattaattcttctgatctatgagcatgtgatatttttctaattgtgtcatctgcatttctttcatgagtgttttgtagttctctttagatctttcacttccttgattagagaactattaccttgcatttgttgaagggatttctcactgcaaaattctgttctacacactagtaaattctcacaagtctgtgaggaaatttatagaagcttttcatactctgaatttatggctgataaaatttaaaaatatatacataatttgactattagatcagattctgatatgcaggagatgtatatcctggcctaaaataaattacattgatacctaatccccatcctgccaggtaggaaagtcagttatagttaatgctttctcctttcaaagcataaccaggaatctagcaaaagtctaatgtctcatgaaaagtaataaattctagaaagcccctttgttctattatccatactcctggtaattgtgccctgggttccaactgacagagtcttttaagtctgtcaagcgcattggcttagaagacttcctgctttgctaaatgacaggactattggtaagatgaggagcccctacccacctcagggagtctccctgaatcacccagcctccgcagtttctacacctttgccatttccctgacacataatggacaagccaagctctttcctgtctctgtacaaatctattccttttccttccatctgtgattgtagacactctctcctctctcccttattcccaaatggagtttactttcttgcctgtcctaaaactttagcaacaggtacaaagacatccggcagacattgcctttaacatttgtcaaagtccctgaggcaagacattaaaagagactgagtacttggatgaaaaatacaaaagactgatacaaaattaacatctcagaaattattttgctgagaataaaaactacaggaactacatgtgatgccatgagtcgaaagcattggaaccttggcttcctaaatccaaattcaatacttttttactatatcattttgtggattttgtatcctcaattagtgcctgttctgagattattgtacgtagtattattctaactagttttcattttcttgctagtttgtctgataaaatatctgatatctggctgttcaccccagattatcaagattgtctacataatagttcctcatgtcttctattaattttttttaaataagcatcagccgggtgctacacaggtagtgtgatgaacgaggtctttatccatgtgtgatgatgttgtgggaggaaacagtggctgcttgaagaaaataatctaaactgagaactgaagaaattttaggagtcatgcagataaataggatgaggagggaggatggagagatagtgtttggcagaagaaggcataaattcaacgtccaagacagtgcatgggccttcccaagaattaaaagaagttcaatacagcaaatcttcaaaagccttatagatcaagttaaggaattcaggttatgggctaatgattttggagaaatgtcactaaaggactcaggaattatataaagagtttgatgaaaccagagcagtatttgataaagataacggaatggagcatacaggacggaggaaggcagcgatggtggttgggggaggacggtgcacaatattaggttctggaaggccactgaagagactctgacagtggttcaactatgaaaatattcataactgggactaggaaaatggcgagccaaagagccaaagaaggaaaattttaaaaataaattccagtggtatgttcagtaaggttttttatgaaaatacattacagtgactcatgcagtatgcccttctcgcttaaattcctatggtacagaagcagacaactctagatgctcaatctttcacccctgccctcccatgtagccatagtgaccatgtgccagggctctgctcatgagttaaaacaccagaatcatcgttgagggtatctcttcccaaatcaaaaaggcaaagccttgcagggtggaaatccttttgccatttactatcatccatcctaacccagaccattcttaaaagatgatgatgcttggaaaacaatttttctttcagttatttaaattaagagcttacattctccaagtgcagaatggaagaggaatgtatccatgtgtctctttagataataagctgacaatccaacactctgcctcagccctccctgctccctagcccatgcaactagggctaccaaccacagctaataggcctcatgctgtgtgcatgcccacagtgcatggacttcaaaacttctcatttgatccttaattaaaaccactttgctgagcaaaaagctgactgattgccttaggagatctacaaaatagacactgttttatttatcagtacctgaatttatacattacacacattataatttacaacaaattatgtcatttctatgaggatgtcttattacctagaaataactactacattaatagaggaaaaaatgtacttgccaagtctttcagaccagggagggctgaggcagagtgctggattctgtcagcttattatccaaaaagacaggtagataaattcccctttcattctgcacttgaacacctagttattatcctccttgtgcttacattgttaagcctttctcctggaagtggcagatagtaactgctttgaaataatgcttaaaggatctctatgtgtctggatggagttaaggcacactctacatgtggaacttccttagagtgggaatgagcgctgagcttgaaacatttctggaaacttcaggaaccttggggaatgaaaaactataaataaatgaaatgagagcattcctgaaacctgtaagcagggtagaactccctggtataaccttgaaagtgaatatggattttgctttcaggccatagaaatgagctcacaactgaattagaaaaaccaagcagatcctgaattattctgctgtttcccagtgtacctgtaataatgtggcttgatagaattgattttttttttttttgagatgggttttcactctctctcccaggctggagtgcagtggcttgatctcagctcactgcaagctctgtctcctgggttcaagccattcttccgcctcagcctcctgagtagctgggactacaggcgccaaccaccacgcccagctaatttttttgtatttttagtagagacggggtttcactgtgttagccaggacggtctcgatctcctgacctcgtgatccgcctgcctcggcctcccaaagtgctgggattacaggcatgagccacagcgcctggccgaattgattttttttgtaagaaataaatgacttcctggctaaaagtgaataaagaattagtaaactaattggtgtgttttctaaaatagaagtggtaaattacctagataaaagataagagatccaattttaaaaatatggaataattatttaattagaaccttcttactatgtaaacaccttaccttaattcgtttccctagttataaagcagtttccatatgaactggaagcatatatgttttcatgtgtgttttctaaagactgctacagctcctggcacataataagtatgtaataaatatttgttgaataaatgaattttcacttgatttattaatacttttggtcagcaaattttctgagatgatgtttttttaactgtaaattgtaactcgactattggctgaattggacatagagtttgcctaaaaatttatggtcattcaaacatgaattgaccatgttataaaaatacagggattacattagcaataactaaaatgccaatttcaaatactatttgaatttccttttctttcctctattctgttcaccacctgagaggaatatagctttgcatgtgacatttaaaaatataggatagcagtggctacagctatcctatagtgacttcattattgtctttcataaatatttgaatcgtcttatttgtggaaaaatattgctttgtgtaacatgctctgaaaaaaaaaatccttctgtatgtgtttcatttcattgtttttgatgtgttttcttccaaccactagttaaaattcaaaaatcaaaattaattgtaaagaagtaaagtttgttactggagaaaaattaagacattttcccactatgttttgttgcgttcttttgaatgctcattctctcattatgcagttgtattatgatcaactcctcatcattgtttaattgtgtcctaactacagtccaagtgaccttctataatgagcttctctttcagggatcagctcctcctcacatttgaaaatatcgtagtgttttgactattattttcctacttcatgttatctggtaattatggcaatttacctttctacctggcattataaaatggtatttttctcatattacatttattttcttaatgacaacaattattttggaaagaacatatgtgagaattacagaactgagatcttttcaaaacctactcttttgacattctcaaaactaattgtcatttaaaatgacctgagaagctagagctcctatgagctggcacaatcctggcaagggtcactctcaaaatatccactgcaacaaagcccatctatttgatgctggcatgagttattaaccaaaataaaactgagaccatgaactcaggttccctcaagctctgcacagctaaaagctcagtaagtgagtagtatatggttcagcaaccctcctagaagagaatgactcctttcacaggtgcttgttgtacttttggaaagagacttaagctattctctagacttcttggttattactcatgtagttagcagagcaccatctgattatttattactttaggagcttgctttccttatctaaatcatactgtaaaacattgagttattttcctaggattcagttatttcatcaaaattttctttttcctatttggccctttagagtgaattatccttaattattttatctgctttatttgggaaagaaaaccattgcaactgtaggtatagggactttctctttcatctctgctgtgggattagtctgctttaactgaagagagtaattttaatgagttcctctgagacaaattttaattgaaacaccatgaattgtaacttttatgaggaaactttcagtttgtatttggttcctactagtagtattttctttagctcagtatgagaccgaaccatatttgctctatctgcatagatttcaataacaacaacaaaaaaagagtatcaacatttttgtggctagttctgtaaagaaccctttgtacttaaatctagtttatgtctgttttcttagctttacttatattttttatcttaagtagcaagcagcaagtatgaattgaatctcacctagcccttaggtttgcccttaatgatcttatagcttagctcctcagtgaacctccatttcttctaatacattggctctccaagttatatagtctttcctttgaaaatattgataattgcaatgaagtaattactattttaaagtactagagcttcagataatatttttaaagtttagcttttaaatgtgtataaaatgtctaatagagtgtagcatttggtgggatataatatacaatatcatgtaacatgatataaaatatttatcatatcatataataatttatatatgtattcactaatttggaaagtggatgctacataaaaaaagcttatgttatttttgacaaatactattaattaatttttaacacaaagaccttaaacccaaattaagaaaacccacataaaaaataaagacctaaaacacacataaaaaacaagcaagaataagaagaaagagaaggagaaaaagagaaagagaagaatgaaaaggagagccacactgcttatgtatacatgataaatctgaaattgcaacatcatccatttccaatacccccacaaaaaaaggaataatagaagcttattattcaaaacattattcaaagcattcaaaaaacaaacctgtgacagcgtgaaaaccattccaggattttcagttgcttctaatataatacataaagctgacagccattaatatcacatgtcctttgttttgagagactattattactttcagatttttatatagttttattgtaaaagtctaacaataatcccaaaacataaattttccccttaaagattaagaaactgacattttggggattaaaataagtggcaagataatatacattacaaataaaagaatgggagacaaaaaccaagtcttttgatactttataaattacacatggattcctgctccatttcacatcaatattttgtttataatacttaaagatttttaaaggctaattcttcacattataattgttagtatgatactaaaaaatcatatctgaatgcaccagattattatatactagttagctcagtttctctcaatatgtagatttagtttttcaaattcttaaattcaataggaattttatgcctagaaatatgttatctataagattgatgtagtgtttttccatggagtctaaaggcaaaggcaattgatgagggctaaataattgggtatgcataagttttcaggccatatcacgcttatcccgccacccccctccccctgccccagtattaattttatgtacatttctcttctggcagccacattccaaagctgtaatatacaagaggctaaaaaaaattctgccaaaattatattttaataaaagcaatggctattttaggagaggaagttgaagtaaaacaattcaagtcatgtatttaaaagataattatattaaaaataaccatagttagggatgatttctaaacctgtcattgcatataaagacaactattttagaacaaaattttagaacagtagttcaccaaattatctgttcaagttcaacactcactcatacattcattgtataaattaaaaccctgtttaatataatggtgatcagttctctaactttcataaacatgtattgtgtatcaagtgtagagtttctaatgggcacagtgttcatcacaatcattacacctctcaggtactttcatgtaaactatatttttaaaaatatgattttgaagagatctgacaatgttatttttcagagaaagaacaaccaatataatgataaattatagcataaaaaaaaaacttcctgacatctgcaaacaagtctgttctttaagcagaaaaaaagaaaattattgaaggcaaatttagtggcagttcactgacacttttaaaaaagaatgacttccaaggtttccaagagaataggataatattgcatgaatatggtttattaatattcatactgatacaatccataatttctgtaaaattgatcttcagttgtagttatagaaagattcagacaaggagaattccatgagtggagcatgaaactgggactaagcctgatcagattacataccaggaagtgtactgacatcatggttgtttatttcctttctaagtcatacagctgataacctatagttattagataccgaaaggaatgaagaaaattttataaaacatagctgaaagtagaaaatgttggtataaagacagaaaagctatttgattaatgtaaaatatagatatttctaatactggtgaatttggatttattaatagttatcctttaagaaattactctaattgaaggcctttctacatcccaggaggatctcttcattcaaaaattttaccagaataatagtttgcatatttcagttgtctgtactctctgtatgccacatttgttggaacaattgaaagtttgtgagacatagatcactagtaatttttcattccatttctatcgaaatgagggagaaagaatgtttatacttcagtgggcaggttgaaagtcttttctggttccatagaaatgtaaatccaattatatttaaaaggaaaattacatatcacttatacttcttattataaaactttcatgagttgtcttcttttatttatttgatattctaagtcatcctactcttcactccaccccatctccaaccacattggccttgatgaagaatatgtttatgtttttatccttggatgacaatagcaagtgacttattttctatcctctcatttttcctcatgcccccaccctttttttgtggtacttagtgaataagaattcacctttcttttagcatcatgtgcaattacataataaatggcatatgttcttataaggcatttgtggtcactcatgatgaaattaagatggcaattgttatagaaacttttaaatatgattatatatgcattaatgactcaatacaatgaaaaacctcaagtttgagagaaggatattattattattaagtttatgtatatttcttttcaagcaaacaccaataattatgtcattaaagatctaactagaactaatgagaatgagctagttaaatcacaggaaacaccagcactgacctctgttctgcgtagtcactgtggctgagctggtcatattgcctatgtggggaagaggtccagatggctacttattctcattctcacttgcacaggatataaaatattagcaatacatctgtataaattaaaaatatattataaatatattactatacaaaacattttgcataaattaaactgaaatagattaaacacaagaatgcacatagtaatcacagcataatacatttccttaaactttttttttaaattgaaaatattttttatttatttatttatttgtttttattatactttaagttttagggtgcatgtgcaaacttaccttcaacatttgtgatatctaaaagccatgaccatttcagggtctctgttaatacttacctacggtcatttttttttcttgaactcatttaggatcacagcctctatattttccttattatatagtaaaatgcaatttcattcgtcttcttacaatgctacaaataagagattataaaattatttattttattagtcttttacttctttattgaaagaaatcaatcaaaaggcgtatatctccaaattttgtcttctctcttgtagttttctaatcttttttattttgatgcatttaatctattttgcccctttaccaatggcttctttattttctttatagtttttcttactttctttgatagtttttagcatcaacttctcatgcttcaaatgacatttaaaatacttcactcattattgtattgcccattttcttagatgtagttaaaaatgttcagtccatgacattctgacagtttgcgatttttactcaaaggaagatgctagcagaccaagtgagacacatttggcagttgtgttccatttagtttgagttaataaaacaagggtgggggcaggggtatcactttgtgaggaatgcaatgcatgggaactaaatcaagcacttcttgggaataaatgaggataggagggggagagagaaaacagaaattctgtagtacataaattacagatattttaacagacaaaaaaaaaacactttatcattagtccttagtgactgtaaaaactttgtaattttatctgtgtaagcagaacccatatttgctaatggtgaatgaaactaaataagattcaacatgattaaaatgttaacgtgtaatatttaacaggatttctcctgcattgtctcagacaagaaatatttttcatgataatttggtaactacaaaattaggaaataaaagcttttcagaagcccacatagaaagctgaaaaaagatagaatactaaaatttctatacaacatgtatattttaaacacagctaattattgatttcattcatagcaaattcttaacatccatgtgtacatatagatttatgttatctttttaaaatatatagattcagcatgaatataaaaattttaactcttattctaaataaatattacatagtgctttcgtttaatgtaaaaatgtgagctatctccaggtactaggcatattagcaaactatatctaaaaatgaagagctgggcgtggtggctcacgtctgtaatgccagcactttgggaggccgaggtgggtggatcacctgaggtcaggagttcaagaccagcctggccaatatggcaaaactctttctactaaaaatacaaaaaaattagccaggcatggtagctgatgcctgtaatcacagctactggggaggctgaggcaggagaatcacttgaacccaggaggtggaggttgcagtgagccaagatcgcaccactgcactcgagcctgggcaacagagtgagactccatttaagaaaaaaaaaaagtgccacaatcagaaaattgagactgagtattattaacaatgactagttattatccccgcatggttgcactgttttttcttcttttctttttttaggtttttttttttttttttttttttttggtaactagctagttctggtttactctataaccaaatatgtgtagttttaattttcttcagctatgttcttattcattaatactgccttggatttgtaggtactgtgcatttttcaaatacatttttaattcagatcctcaatctcactatatacaacactccccctctacccctcccacacacacacaggtctacccaccaccattaacactaccactaacggcaacaataacaaaaataaacagaaatatatagatcatcattagtaacaaccttgccaaattaactagtaagttaatttttatactttaaaattttgtaggaagttttgtatacactcgttatcaaaaataaagttttattttttctttactatatacatatatatagcttttattttttcttgccttatatcacttgatagtatcaatagatagtatcgatagggtccagttgaatagaagtattgatgcttgacattattatgtttctaacctcagggggaaagtgttcactaactcatcaatgatatatgacatttgctgtattttcattgtggataccctttgtcagattcatgaaaattcccttctattcctagctttctgaaaattttcattaagaatgtgtatcggcttttactccaatgaatattttgcctatattgagataacattaagacctattctgttactgtggtgaactatgtatttattatattgaatgttaagccaacattgtatttttggaataaatctctattggtcatgatatattatattttaaaatattggtagattcaatttgctgatttttttattatactttaagttttagggtacatgtgcacaacgtgcaggtcagttacatatatatacatgtgggagttggtgtgctgcacccgttaactcatcatttaacattaggtatatctcctaatgatatccctccccacttcccccaccccacaacaggccccagtgtgtgatgttccccttcctgtgtccatgtgttctcattgttcagttcccacctatgagtgagaacatgtggtgtttggttttttgtccttgcgatagtttgctgagaatgatggcttccagcttcatccatgtccctacaaaggacatgaactcatcattttttatggctgcatagtattccatggtgtatatgtgccacattttcttaatccagtctatcattgttggacatttgtcttggttccaagtctttgctattgtgaatagtgccgcaataaacaaacgagtgcatgtgtctttacagcagcatgatttataatcctttgggtatatacccagtaatgggattgctgggtcaaatggtatttctagttctagatccctgaggaatcaccacactgacttccacagtggttgatctagtttacagtcccaccaacagcgtaaaagtgttcctgtttctccacatcctctccagcacctgttgtttcctgactttttaatgatcgccattctgactggtgtgagatggtatctcgtggttttgatttgcatttctctgatggccagtgatgatgagcattttttcatgtctctgttggctgcataaatgtcttcttttgagaagagtctgttcatatccttcacccattgttgatggggttgtttttttcttgtaaatttgtttgagttctttgtagattctggatattagccgtttgtcagatgagtagattgcaaaaattttctcccattctgtaggttgcctgttcactctgatggtagattcttttgctgtgcagaagctctttagtttaattagatcccatttgtcatttctggcttttgttgccattgcttttggtgttttagacatgaagtccttgcccatgcctatgtcctgaatggtattgcctaggttttcttctagggtttttatggttttaggtctaacatataagtctttaatccatcttgaattaatttttatataaggtgtaaggaagggatccagtttcagctttctacctatggctaaccagttttcccagcaccattaaatagggaatcctttccccatttcttgtttttatcaggtttgtcaaaaatcagataattgtagatatgtggcattatttctgagggctctgttctgttccattgatctatatctctgttttggtaccagtaccatgatgttttggttactgttgccttgtagtatagtttgaagtcaggtggcatgatgcctccagctttgttcttttggcttaggattgacttggcaatgtgggctcttttttggttccatatgaattttaaagtagttttttccaattctgtgaagaaagtcattggtagcttgatggggatgacattgaatctgtaaattaccttgggcagtatggccatttttatgatattggttcttcctacccatgagcatggaatgttcttccatttgtttatatcctcttttatttcattgagcagtgggtttgtagttctccttgaagaggtccttcacatcccttgtaagttggattcctaggtattttattccctttgaagcaattgtgaatgggagttcactcatgatttggctctctgtttgtctgttattggtgtataagaatgcttgtgatttttgcacattgattttgtatcctgagactttgctgatgttgctcatcagcttaaggagcttttgggctgagatgatggggttttctagatatacaatcatgtcatctacaaacagggacaattcgacttcctcttttcctaattgaatacccttcatttccttctcctgcctgattgccctggccagaacttccaacactatggtgaataggagtggtgagagagggcatccctgtcttgtgccggtattcaaaaggaatgcttccagtttttgcccattcagtatgatattggctctgggtttgtcacaaatagctcttattattttgagatacgtaccatcaatacctaatttcaatacctaatttattgagagtttttagcatgaagggctgttgaattttgtcaaagaccttttctgcatctattgagataatcatatggtttttgtcattggttctgtttatatgctggattgcatttattgatttgcatatgttgaaccaggcttgcatcccagggatgaagcccacttgatcatggtggataagctttttgatgtgctgctgaattcggtttgccactattttattgaggatttttgcatcgatgttcatgagggatattggtctaaaattctctttttttgttgtgtctctgccaggctttggtatcaggatgatgctggcctcatgaaatgagttagggaggattccctctttttctattgattgaaatagtttcagaaggaatggtaccagctcctccttgtatctctggtagaatttggctgtgaatccatctggtcctggactttttttggttggtaagctattaattattgcctcaatttcaaagcctgttattggtctattcagagattcaacttcttcctggtttagtcttgggagagtgtatgtgtcgaggaatttatccatttcttctagactttctagtttatttgtgtagaggtgtttatagtattctctgatggtagtttgtatttctgtggaattggtggtgatatcccctttatcattttttattgcatctatttgattcttctctcttttcttctttattagtcttgctagtggtctatcaatgttgttgatcttttcaaaaaaccagctcctggattcattgactttttgaagggttttttgtgtctctatttccttcagttctgctctgatcttagttatttcttgccttctactagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttttgtctttattctcattggtttcaaagaacatctttatttctgccttcatttcgttatgtacccagtggtcattcaggagcaggtggttcagtttccatgtagttgagcagttttgagtgcgtttcttaatcctgagttctagtttgattgcactgtggtctgacagacagtttgttataatttctgttcttttacgtttgctgaggagtgctttacttccaactatgtggtcaattttggaataggtatggtgtggtgctgagaagaatgtatattctgttgatttggggtggagagttctgtagatgtctattaggtccgcttggtgcagagctgaattgaattcctggatatccttgtgaactttctgtcttgttgatctgtctaatgttgacagtggggtgttaaagtctcccattattattgtgtgggagtctaagtctctttgtaggtctctaaggacttgctttatgaatctgggtgctcctgtattgggtgcatatatatatttaggatagttagctcttcttgttgaattgatccgtttaccattatgtaatggccttctttgtctcttttgatctttgttggtttaaagtcttttttatcagagactaggattgcaaaccctgcctttttttgttttccatttgcttggtagatcttccttcatccctttattttgagcccatgtgtgtctctgcatgtgagatgggtttcctgaatacagcacactgatgagtcttgactctttatcaaatttaccagtctgtgtcttttaattggaggatttagcccatttacatttaaggttaatattgttatgtgtgaatttgatcctgtcattatgatgttagctggttattttgctcgttagttgatgcagtttcttcctaccattgatggtctttacaatttggcatgtttttgcagtggctggtaccggttgttcctttccatgtttagtgcttccttcaggagctcttttcgggcaggcctggtggtgtcaaaatctgtcagcatttgcttgtctataaaggattttatttctccttcacttatgaagcttagtttggcaggatttgaaattctgggttgaaaattctttctttaagaatgttgaatattggcccccactctcttctggcttgtagagtttctgccgagatatcagctgttagtctgatgggcttcccttgtggtaacccgacctttctctgtggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatttcctgcagagtgttttccacttggttccattctccccgtcattttcaggttcaccaatcagacgtagatttggtcttttcacatagtcccatatttcttggaggctttgttcgtttctttttattcttttttctctaaacttctcttctctcttcatttcattcatttgatcttccatcactgataccctttcttccagttgatcgaattggctactgaggcttgtgcattcgtcacgtagttcttgtggcatggttttcagctccatcaggtcctttaaggacttctctgcattggttattctagttagctatttgtctaatcttttttcaaggcttttaaacttctttgccatgggttcgaacttccacctttagcttggagtagtttgatcgtctgaagccttcttctctcaactcgtcaaagtcatttgccgtccagctttgttccattgctcgtgaggagctatgttcctttggaggaggagaggcactctgatttttagaattttcagtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgttttcctgggtatcagctgcggaggctgcagaacagcagatattggtgaacagcaaatgttgctgcctgattgtgcctcttgaagttttgtctcagaggagtatccggccatgtgaggtgtcagtctgcccctactggggggtgcctcccagttaggctattcagggttcagggacccacttgaggaggcagtctgtccgttctcagatctccagctgcgttgctgggagaaccactactctcttcaaagctgtcagacagggacatttaagtctgcagaggtttgtgctgccttttgtttggctatgccctgctcccagaggtggagtctactgaggcaggcaggcctccttgagctgcggtgggctccacccagttcaagattcccagccgctttgtttacctactcaaggctcagcaatggcgggcaccccttccccagcctcgctgctgccttgcagtttgatctcagactgctgtgctagcaatgagtgaggctctgtgggcgtaggaccctccgagccaggcatgggatgtaatctcctggtgtgctgtttgctaagactgtcggaaaagtgcagtattagggtgggagtgacccaattttccaggtgctgtctgtcacccctttccttggctaggaaagggaattccctgaccccttgaatttcctgggtgaggcaatgcctcaccctgctttggcttaggcccagtgcactgcacccactgttcttcccccactgtccgacaatccccagtgagatgcacccagtacctcagttggaaatgcagaaatcattcgtcttctgcttcgctcatgctgggagctgtagactggagctgttcctattaggccatcttggctccacctgtccttgctaatattttttaaggatttctccacctatcctcatgagaggcataaatctgtggcattcctttctcacaatgctcttacctggctttgatatcagatccatgctggcaagaaaataaaaataagttcctctgttttctaaaaaatttgtataagaatattactatttcttactttattgtcagaaaaattcaccagagtgttcacctgtgcctggagttttcaacttttaaaaatagatataggactattttgatattgaatttcttcttgttaatcttggtaacttttttttttaagaaggaatctattcatttaagtttggctgtttgttttctatatgtctcatttgttatataatccttgattcatcctttttctgctttgttgttacacagacaggatttttattacttcatttctctttattgttaggttttatattagacattcttgtgctacatttaaatttttatttatttatttttatttttttgaaatggagtctcactctgtcacccaggctggagtgcagtggtgcgattttggctcactacaacctctgccgcccaggttcaagcgattctcctgcctcagcctcccgagtaactggaattacaggcatctgccactgtgcccagctaatttttgtagttttagtagagatggggtttcaccatcttggccaggctggtcttgaactcctgaccttgtgatccacctgtctcagcctcccaaagtgctgggattacagacgtgagccacagcgcctggcattaccctagagatgtcagtatggattattaacttactacacttcactctgattaagatgtactacttccagaataaggcatccccaacaatttactacctttctggttatgtctgttactactccaccttatgaaaaccacactcttgccataccaaaccttagttgcgattcctaatctccctgtatgcactcatctctcagtatcatgtctgtgacacttgttttctgcctgcctacctgttgcctttaaaaaaataaattgtattgtgtatatttaaggctcacaatataatgttatgggatacacatagattgtaaaattattactatagtgaagcagattaacatatgtattatctcagttacttttgtttgtgtgacaacagcagataaaatctacttatttaacaaaactccctaatacaataccattttattaccttaatccttatgtacattagagctctaagcttgtttatcttacatatatgctgttttatatcttttgacttacatctccccatttccaaactgccctcactcccctgcccctgcccaagaatgaaacagtagttactgtctgtttatgtgtcccatctcattgtgataaatcctttgtctgcctcataatacaaagtgcattaattcatttctccattcatttcagaggggaacaaatcactttgctaatgatttctcacccaaagacataaagacacattcccagctctcaatgctcctagattattaaaatatgttttaaatcacaatattctgggttttttttctctcaaacttgatatcagagttaataactgtggtgttcatatttcatccccagaccttgtcacagagtaggtgcttaatatgtgcttttgaataagtacatgaataactttcttcatttcccctgagtaataagcccaaattcttagcacctcattttcatatggcactcataaaatatgtgtggcgtacctgttatgtggcagtcactcttgttgctgctggagacattacgatgaagatcaaaaagttcctgcttctgcggagcatacatcccaatgggaacattagtcggttaataggtgaaaacataagtgtagaatagtaagtagtatatgggaaaaaaaaaagcaaatttgggaaataggtcctgatgtcctgggtatgctggtttaattgtgttaattatgaaaactctctccaaaaaatcatatttgagcagaggtctggctataaaaattcttgagtgtttcagctgcttattgctcaaaattcctcagaagaagtgtaaaaacactgatttatgtttctcttgtattctagttacttgtaagaaatacttaaaatactttaaagtgtcactagcagggttttttttcccccggacataaacctactttatctctcagtattccatcttaagagatctctatttagatagacttattatgttccaaacaggattttcaaaagtcttgtctgtacaaattcattcacccccatttcttcttatgtaaagtctccctagccccgtacttaacacaaaaactattttaattctctactcttcttccaatgtgagctgaaatctcactttttctagttgcagtttccaggttatacaaagttcattagttttccacaattttgaaactcttctaggtcttattgtttagttcattcaattccacaaatatgttaccatatcacaattgctggtttataagttttccctatatcttttcaattatagaatatttctagctgtttggataggggttatactatccatattttcagtttccctacccagtggtgcatatagtagacaatcaataaacatatcaaaaattggtaggtgtgccaatgtacaagactgccatactaaataaaatgtcatttagccagggggaaaaatgccaggtagacaatgagaaaattaacataaattacatgttaagtatctactatctgccttaagtatacatagtatcaaagacatatttgtaagacagcaatttttctgcttaatacttatatatttaaatataatatttaatttgtatattttgattatttaaaacatctcacatacctttcatactaatttgaacatagcagatggtacactaattctcatatttaaagaaagatgctgtattgattttacatttgataatagtaaattatattataaattttagtgttgaaatagatgtagcaatagagaaataatcactgttaaatcctctgagtattatcataaatattcaaacatacaattttttttttgtttagagtcttctgctttattttgttttgttgtttgcaaaagcaatgtaagactgtatgagacaatataaaccttgaggctctacctattagaacttaagatgagttgatagaatttgcagtaaaaactgctggctttgtgtataaaaacataccattttaaatcctattctcacaactgcaaagaaggaatgtctagtatgccataattggtgactcaccagttttgttttatacctttagagaatcattcattcatttaaaaagctttatctcatgagattcatcactctgaacaccaaattgatgtacaaataaaataaatttccctttaattgacagatggtctaatgaatgtgtagcttcaaatttttattttgtagtcttagaagtgacagaatctaaaggctcagcactaaaaatatgcgtacaaacattttttaaaagaagctttgggtggatgtatacattttacttagggcatatgaatttgaaaataaaaatatgttggccgggcgtggtggctcatgcctgtaatctcagcactttgagaggccaagctgggaaagtaacctgaggccagaagttcgagaccaacctggctaacatggtgaaaccctgtctctactaaaaatacaaaaattagctgggcatggtggcaggtgcctgtaatcccagctactcgggaggctgaggcaggagaattgcttgaacttgggaggtgcagcttgcagtgagccgagatcgcgccactgcactccagtctgggtgacagagcaagattccatctccaataaatgaataaataaataaataaatgaaaacaaaaatatgttgaagaaaggaaaggctactttacagtacaattttcttttttaattatttccattgtttgggaaaacaggtggtgtttgtttacatggataaattttttagtggtgacttctgagatttgggtgtacccatcacctaagcagtgcacactgaacccaatgtgtagtctttcaccctttaccctggtagctttacccctgagtgcccagagtccataatattattattatgcctttgtgtcctcatatcatagctcccacttacaagtgagaacatacgatgtttgattttccattcctgagttatttcacttaaaatgatggtctacagctccatacaggttgctacaaatgccattatttcattcctttttttggctgagtagtattccatggtatgtatatgctacattttctttacacactcattggttaatgagcatttaggctggttccatatttttgcaattgcgaattgtgctgttataaacatgcatatgtaagtgtctttttcttatgatgacttctttccttctgagtggatacccagtagagggcttgtgaatcaaatggtagttctacttttagttctttaaaaaatttccatactgttttccatagtggttgtactagtttacattcccaccagcagtgtaaaagtgttcctctttaatcacatgcacaccaacatccactattttttgatttttaaattgtggccattctcacaggagtaagatggtatcatattatggttttaatttggatttccttcataattagtgatgttgagcactttttcatatgtttgattctgtatgttagtcctttgtcagacacatagtttgtgaagatgttttcccactctgttggttttctgtttactctgctgattatatctttcactgcacagaaacttttgagtttaattaagtcccatctatttatctttgtttttcttgcatttgctttggggttcttggtcatgaagtctttgcctaagccaatgtctagaaggggttttctgattttatcttctagaatttttatgattttaggtctaagatttaagtttttgatccatcttgagttgatttttgtataaattgagagatgaggatccagttttgttcttctatatgtggcttgccaattattccagcaagatttgttgaataggatgtcctttctccactttgtgtttttgttcgctttgtcaaaaatcagttggctgtaagtatttgcctttatttctgggctctcaattctgttccagtggtgtacatgcctgtttttataccagtaccatgctgttttgataactatagccttgtagtataatttgaagtcaggtaatgtgatgcctccagatttgttcctttttctttgtcttgctttggttatgtgggatcttttttagttccatatgaattttaggattgctttttctagttctgtgaagaattatagtattttgattggaattgcattaaatgtatagattgcttttggtagtatggtcattttcacaatattgattctacccatccatgagcatgggatgtgttttaacttttttttttttttttttttttttttttttacggctcttgtaacagtggttaagttgttgatttgattctcagcttagtcaccattggtacatagcagtgttactgatttgtattcatcgattttgtataccgaaactttactgaattcatttaccagtaaatgaatttttactgtttactggtaaatgaattcagtaaagtagtaaactaagagttttttggatgagtctttagggttttcatggtacatgattatatcattggtgaaccatgacagtttcacttcctttttaccaacttggatgccccttatttctttctgttgtctgattgtcctggctaggacttccaggactatgttgaaaagaagtggtgaaagtgggcatccttgtttttttccagttctcaggcaaatgctgtgaactccctcctgtcccattcaatataatgttgcttgtgggtttgtcataaatggcttttattaccttgaggtatgtcccttctatgccaattttactgagggttttcatcataaagggatgctggattttgtcagatgctttttctgcatctattgagataatcatatgatttttgtttttagttctgtgtatgtggtgtatcacatttattgacttgcacctggcataaaattttctttttaaataggatgtatggaatgacatagatctagttaaaaccagagactatataagtccaagagaccttacagcaaattttgtcattaatggaagaaagatttatgtcgtttaaacatttccgcacgttatatggctaatttctaactatggaagtgctagtgaacattagtctctcttttatttacttacatgtaacttaggtagcagaatgtttatttcaaggcgtaactgtgttgggttaaaaatttatatgaagtaatttaacacaatactttgtatatcatggatgctcaataactagctgttatatacatgaaatttctcactgatttgttttccatttacgttgaaaagtaataaatgacattttctcctaagaaatcaaacagggaagcaaagaagatgaaatttgtttttttttgtttttatttttggttttttggggccaaatgtcatttaaagatttttgtttcttttcctttgattggagaggtttccagtctgctttttgagaatataatttcttatcaatccccagccgtatgatcttggctgtcagggctattgaatttaagggcagtagtagtaagaaactaagaaaagaaagatactttttttttgaggaatcactgatatggaaaccaaattttctaacaaaatcttgaattctagtaatacaaaatgaataacatgtttgtaaatcaaggttactaaagtgaaaaatataaaaatctctaaagatttttaaaaagtgtttttaaaatcatattaatgaataaagaccttgttttaaagggtactagaaatattatttcttaaatgatgagttatagatgcatattattagacactcaagcacatacacacacaaatacatattaattactcagcttaattctgtaatacttaacagcaattgtattaaagtcaataccagagtaaatgcctgttaataattatttattgttaactatataattagataagaaatcatgagttatgaagaaagaggaggcaaaaatattattatttgaagtaaacattgtgtatctgtaaaacactagtttttaaaaattatttaaaaatagttcagtttggtagctgaataagaagtataaaaataaataactttagtgtgtgctatttagaaaaatgtaatgaaggaaaggatactacaaacaatacaatgaaggtaaaacacatctacaaaaatttaccaaaaattgcataggactaaaagaatgaaaattgtataaaacgccactgaggtccaaaagcagaacacttgaaaaatagctgatatatataaaaatatcaattatataaggatgaacctgaaaatctaatgtaatctaaaaaacaaaatccagaaaggccagtttattaaaccgttcatacagaaaaataaacatgttatcagttggaaaaagaatacagtaagaaatggctttgcatatattaaaaggggttactaatgatgtttccaatgcaagcattggcatagcagtgaatgccatgataatgtttaaatatgcatgagcaagtgtacaaaattttgtacatagcattttaaagcagggaagaaaaaagcaaattactcgataattttttttttttttaatatgacagggtcttgttctgtcacccatgctggaatgcagtggcccaatcttggcttattgcaacctctgccttctgggttcaagcgattttcattcctcagcctccccagtagctgagattgcaggtgtgtgccaccacgcctgcctaatttttgtatttttagtagagacggcatttcgccaggttggccaggctggtctcaaactcctggcctcaggtgatcagcctgccttgacctcccaaagtgctgggattatagacctgagccactatgaccagcctcaataaatagtatttctataactgcctgaacatttgctttgaaaaaaataaaaattatatttatcgcacttctcacaccaaaacatattccagatgtttcaaaaattttgatagataaaataaaaacagaatggtagtaaaactctgagtttttaaatagatactaaaagtgatactagactagggaaggccttctttgtaaatatataaaatataaaacgagaaattataaaagaaaaaagtaaaatcatctggatggaaaaattaatctgatttaataaaataaaatatttgcaacatatgtaattaacaaaaatataataaatatagtatgtaaaaaacaaaaactgtttttaaaaatgcttgaacaatcatttcacaatgaaggaaatacaaatgataaagatataagaaattattaattcatagtaatcaagaaatgtcaaattaaaatatgaggaatatatattttactgatgaagctgaaaatttacagtgtgtctcaggatgtgtcaaaactgttatatgtactttaaagatatctcagtaattccatttctggggatttatgcttccccttcaaaaatgcataactgtgaaaagcaaagatgttcattgtaatggaaaaattagaaataatagtatattttcagtggaatggtgtaaattggaatacaatcaaataacatcaactattggaagtaaataaaaagtatacaattattctggaaaaatcaagttacaaatcagtgtgtgtattaaaatctgcatacaagtattaataaacgtacactaaaaatcttggcagtggttctctctgcaatgtgagattacactttctacttctgtgtggtttgctttttatattgagtatatttcatttacttaaaggcaattaaaataatataataaaatcttagtactagctccttctgcagagcacagcaataggcgataatacacattccagtcttcctatctgttctagaagataaaatggcttttatagagatgataatctcattttgttttctcctgctagggaaaggtgaacatgggaaaccttacccccttactgaagaggaccatgatgactcagcttacagggaaaatggttttaatattttcgtcagcaacaatattgctctagagaggtctctgccagatattcgtcatgctaagtgagtatcagcatatcagtgatcagggtgggtttttttggttttttttgtcctttgatttttttttaaatgtgtatcactgcgagatatgtaaccaaatattttatcctaataattttgataaaaactcatattgcatcatcttaaatatacttgacctaaattggagtaaccattaaaattttaaaacaatactgaatttctaaaaatccaatacacatttttgttgactgtgttaactcattaacataaaatattttaaggcaatatccatacttttaacttttgatcatgtaaattacaaagcaaatgttttttgctggttattagagctaccagaactgtctacatgtgcatgtcttctatgaacttcattctcaccccagacagatttagtgccatggttgttgcattttcataaagaataccctaaatgaatgcatccataatccaaaagtgataagtagtgattgctggttcaatttcttgtcactttatgaactgcttgtggcttgtctgttgacagtgagttgagtttctattgaactgtaactgcatattatagttgaaatgatactactatatatacttaccccaaatccatcttttctctatccacccccatctacatctaacatcacttattgtacttttcattttaatgtgttattgttttcctaatagcataaacaccaccaaaggatactaactgagaacatggaatgtgataagaatttgtaatgtagtgttggcacatgtatctgataaatctatctaactgtactaatatagctatcctttcacccacaacaacccaaaaacttccctatggaaaccctggtgtgagagagagaaaatcaaggaaaaaaaatcagggcaactaattaaaataagaatcagaaatctaaattaaaccagtaatttaaagcgaataaaactccttaactttgtgcaaagataattgaccctttagaaaaaaatatcagtacattatggtttgaaggactattttctagttgccattttgtatctttagaaatttatttaaaattatgaaataattactgtttttctcctcatgttttatatgaagttgcatttcccaatatagctaaacagaggactaatgtgaagaacaatctttttttcctaaattgagtgctttatatattgacccaggccttttaaccagccaaattatccccacgttacctgaaattatctacagtaattctcactgaccaagaacatttctagttacgagaaattttaatacctaattgcacatcatcaaagatgcattaagttgcattgttggcataataaatatgctaagagagtaatttttatctatccagttcccccccccacccccacacttcttttttttttaggtggagtctcccactgtcgcccaggctggagtgcagtggcttgatctcggctcactgcaagctccgcctcctgggttcacgccattctcctgcctcagcctcccgagtagctgggactacaggcgcctgccaccatgccggctaattttttgtatttttaatagagacgggatttcacctgttagccaggatagtctcgatctcctgacctcgtgatccgcccacctcagcctcccaaagtgctgggattacaggctgagccaccgtgcccggtccccaccccaacacttctaatctcaatctcttaatgtgtattcaagtggaaataatgacaagtttagaaacagtgcagaaaatcactgaagtcaaaagaagacagttattcccattcttctcaaaaactatttttagtgtgaacaccatcttttaagaaaagatcttatgtaataatgggaaaaaaatggaaagatgtaaaaaaaattctgaaatttttattagggttactcaatttacaatatgaagaaagcattattataaatgttacggaagaaaaatatggccaaaatataatctgggataatattccaacttagttactaaggctggatatttaataggacaagtggtcatgtagtaagaaaaaaagaaaaaatacgaaaacaaacaacaacagcaacaaaaaccttgagagggtttgagatggataaaaagaaagtgttaagtatactaccaggaataaggttcaccttggtgaggtcagtatttgactcttagcaatgctggaagagaagcctgatgtcacctctgattttgccatgctccacctgcaggaaacggagagccaaataatgtcttacaggctcccactgtttaaagtactatgcttttgacttcatctgtgcttcaccaaaggcagggcaggtacatttaaccacaagagtatgcagctctgtgtaagtgatctttgaaattataagatcaacttgtgacatatttcagtattatctatttaactaggctgaaagtgatggaccatagcttttttatattgacacaatctatagaatagaatgcaaactttgtgtgacttttaaaataaaacatcacttctaagaaacttttccttttcagtaagccaattgaaactagtctcagagtgctaggagggaagagtttatttttctttattctaggattttgcaatggaagatatggggactcctatcttgagatttaactgaacttgatcttattctaaagcatactagccggacttatgccatgtgataaactattggtcactccctgtatatttaagtgctctgtactctttcatattctcacatttagttaaaaaaaatcatggttttatatgttttgatatgtagtgcacattctagtacacaatgaagaatatttaagacaatgtatttcagaaatcctaatgcgtaggctttttttttttttttttttttttttgaggcagagtctccctctgtagcccaggctggatggcaatgatgcgatcttggctcactgcaacctccgcctcctgggttcaagcgattctcctgcctcagcctcccgagtagctgagattacaggcacctgccaccaagcctggctaaattttttgtatttttagtagagacagggtttcaccacgttggccaggctggtctcaaactcctgaactcaggtgatccgcctgcctcggcctcccaaagtgctgggattataggcgtgagccactgtgccaggcctgcatagggattttttaaagaaattttctgattcatttcttcactagtataaaaataaactgctttttttggctttattatttcagaatcagcatagatttccttaagtaggagccatagacgaaggacagtatattggcatgtgtgcaataatttgatcagtcttacttttatccaaaaaataaatttcaagcttttcacttttgtttttaatttttaaaatagtttttccaaatgctcttaacatctctctatcttacaaattgtttcagcttcttacactatctgtgctttggtatgtcaaatttttaatctttttttatattctcctagccctacactttgggttgattttatttatttatttttttgagatggagtttcactcttgttgcccacgctggaatgcaatggtgcaatctcagctcactgcaacctctgcctcccgggttcaagcaattctcctgcctcagcctcccaagtagctgggattacaggcatgcgccaccacacctggctaattttgtatttttagtagagacagagtttctccatgttggccaggctagtcctgacctcagtctgcctgccttggcctcccaaagtgctagggttataggcatgagccactgtgcctggccctggttgatttttatatattttttgagcatatacttgatgtattttaaatactcactcccttcttctgttagtgccaagtcatgtctgtatccatagtgcctgtgatcagcctgaatctctccttagaacatcttatctttatattttatttaatgcaatgttgaaaagaattttacaatgagcacttctgtatgacaaatgtccagtcaatggatatctcggtggcctggttttattttgccacactttaaggttttctccacttgtgtattgattttgccatgtctttgtatttagtcatctacctgagatgtcacatatattcttagcatgctatggaacaccttatttaacttatagttcaggatgggagacataagacatctatttgaaatatacatataaaatagggaaatagaaaactatgtaaaaatggcctatatagaaaagaagctctgataaatttgtgcatgaatatgttgttgctaagataaaattgaagaatttttaagcaagtattattccctgcatatggaagaattaatcaaaagttatcacaaataccccgtaaacatgatataattagtgtaattaatgtgggtaagaaaaattcatatctatgaaaaaaggaataattgagataaagagctagaagaaccattctaataggagagttgaggtaggcttcacagcagttttgggtaaatgcatctttgatatgagtttcatttttttggccgttataaaagtatatgtgtttatacagataaatatttatgcacctacatgttacctgagatagacttctaaggtggctgagtagctgggatattttaaaattaatatagtctcactttgtattgtgactttttatcatttcttttttatatcactaatattacccaggtagaaatagttttagcttcatgactttgacaataaatggagtatgaggtatcacagagtgttctctcaacactcaatattccattgcttgtcaaagccatgaagctaaaactatttctgtctaagagaatctttacaaccttttggattatatgattgttttcagtagggttgcagttataccagactaatgtagtcctgtttcctgtagtttcagaaccatttgagagatagccccagaaacgatttgctatgaaaacattcgctttattattgttgcaattctattggtgagcatggtttagatgcaggccaagtattatactcaagactgaagtccagaatgaggcacattcagtcttcaagtcacagacattgctggatagcataatcaaaattgtcaaacttaagtcatggatggcagaataagatgactgatctccgcaggcaagcaggttccaaagcagaaaaaaatgaagaaggagctggccaactacagtaagctttgtaacccaaacccacgaatctctttctccgggaaagaaactctgaaaaggtggagaaaggccaggtgcgtttgtctaatgactgtcctgccacatgggaacatctgtagagaaaagaagtctcctcctgtgataagtagtacatacttacaagtacttacatgaagtacttacaaagtcagcactatatgctatttcttgatatatacagacttttgagcaaactcttgatttttcagtgccttatattctaaatactcctgccttcctggaagtatattgaataatgattctaaatatattgacttgcatgacttgcattgtgatgctgaacaagtccaattgcgttttgaatgtttatgtgcccatttccgtaagcggggatgcaagtttcttcagcttcctcaccatgtatgaagattattaaaattggggcaaggtttaccaaatcagcgatcgcgtgatctattcagttatttctttgtcttctgataatgatcttgttgattcccttttttattttccagttatatcatggagatgtaaaatataaggagacctagtgtattctaatttcacaattttaattgtaaatacataattagatttttattagaaagaatagttatgtattcaatttctttcagataagattttgtaaatatactataaatagtttttattttatttttatgcatagtagaaaaatgtgatccgttttgactcttgtctttgtaatcctagaactcattggcaaacatatttgagtttaaccgtccaaaaatttgcaaggataattttttatatttctcaatttcaaaagccacataaaaagtgaatagcactagttgattgccttttccatttttattatgatatccttgtgaacttgattaagtaccttcattcaacaagtttacaagtgaattcagaagcaaaataaactaaaatgactgttcatgcactccaattaggtgtgaatgttgccacagagacagagatgggaaatgtatcctttaaatcaaacactattctagcctagggcacatctaaatattacttaaaaaataaagcaattaaatgataagcaggagattgaaagaaggaatagctagaatcaggtagaagccatctctcaaaactgttatttaagtgagtacccttcaatattttttgaaaaccaattgtatgcacagtaatacagacattagtacataagttctcagggtcattacagaaagtcataatgaaataacaacaacaaaaaatttagatatacctctcattcttgactaaagcctgaaaaagacagaaggtgtttatcactgtaactaagaggtatgtccctagtgaaacaaaaatcttccttggagagataacagtttaagacttgtcagacattaaccttttggagtgactgacagaccatgaggctgggtctttgaaaggctgaatgaggctgggtgccatggctcatgcctgtaatcccaggactttgggaggctgaggcaggtggatcatgaggtcaggggttcgagaccagcctggccaacatggtgaaaccccgtctctactaaaaatagaaaaaattagctgggcgtggtggtgggcgcctgtaatcccagctactctggaggctgaggcaggagaatcacttgaactcaggaggcagaggttgcagtgagccaagatcgcaccattgcactctggcctgggcaataagagcgaaactccatcccccccaccccccaaaaaaaccaacaacaacaaaaaacaacaaaaaaagaaaggctgaatgaggacaaggataagggaactggagtctaaaaggataacaatgggaaaacagtgcacatgaaaaaaaaatctaaaaataaactatggctgcttcaaaatcatgtgtgttgaatatcaaagaacagcctctgtaatcttatgataaggatcaaataaataaaactgaaagcgtaggtttgagcaatagattcataattttgacctttaaagaaaaaaatctgaaaatttgatgtaatcatatacgttgctctgtaaggtttatctagcaactgtatttctaaattttccccttcctcgttttactcctacccacagaagtttactgaaatgacagacagtgatttaagattttaggttgtatataataaagaatgagtctgtaagaaaattctgccattttaaagagaatgctggagcttcctttccaaatcagcaagccatgtaatcttaaactattgttaaagtaatcactagcacttagattgtgatgccaaacagtggcattaataaatgtgattgcggccaaaggataatctgtaaatctaatgctcattcaaattaaaaaattaaagtagatatatcacgtattctcttgaacttaataattaaacagaattggttgaaccatcaatgtgcatgttaccacactacagaagaagtcatttaaaattttaataaatttatctcatttataaagattcttgatttgaatattttaaatgtgcacctaaaaactattaattttattctcaagtattcacagataattgtacttgattttacagaagaaaaactgtctctataaattttattttaaatcattatcttaaaacatactttatcaagattagaaatcctggtaagtatttttcaataacaaatgtgctcttacctgaagcacatttttagttgtctgacaattatttattaagcatgtgagtgacaggcacttagatgagtttataaataagtcatccaaaggttggatgtcagcataaggtactcccctgacttgatccctggtgaagttggtgaaaattatttctttaaaaatatctaagtctctggaaatggtcctaaaggcaaatagaaagggaagaaacatctattcaaggcaatttatgaaaatttggtaagaaaggaatttgtggtatctgaaagaagatcactctatccttctctcccaactcagcaagtcagacactacttcagacagatgcaaccaagaacacagggctttctattggcctcactccgaatccaagagccgtttacctaggaggagcaggacttcaatatctctcatcctgctccttgtttcctgttactaagagaaagtcttgggtaatcatagtacagaggtggcatctcttcttcctcttagccaccacacatgaaacagaggctctacgtggggtatagcatgctgagaatacttcaggcccttattgtactttgcccagtttgtgatgtggtgatttcacgtgagtgatgcaagcagagaggttctcaggctactggtcccctcttcctgagtgcttagcttctagagcagggtgtctttccaggaatgttggccttgtccccacccttatctccagagctttgcttcagagattttgcctgagagagaagcaaggcacaaaacatatagcaccaaatatcttcccaaagaaactgacttctttgcaacgttgcatagagaagttcaaacctaaggtcacgctgaaaaagagattgtggtgaaaagtaattgtacggtggtggtttgtatatttaggaagatacagcctagactgtaggccagccattttgcaggagagaaaaaaagaatgagaaacttgggaggatccctcctggtgtcagaacaaatatcacagagagacttcaaaaactaacccttcaaatgagccacaatttgaacaggttagtgtgtagaacagtttatatcccagggcactgttaaaaacaagaaagcaatcaaccagcaattagtggtgtttaacagcaggatatggtcaggaaagagaggaagaaacccctacgaataccactgtcatctcaggctgaatgtgggcaacccaaagccacagccccctgaggagcaacgctggagacttaaccatgtaatgaaaagaaatggacttcaaacaaaatacggtggttttcttttatctgtgatttcacttttggaggctttatttacctgtggtcaatcatagtcaaaaaataagtgaggacagtacaataaaatatttggagagagagtgagaccatattaacataatttttgatacagtatattgttataattgtttgattttattattgttgttaatctcttactctgccagatttataaattaaactttatcataggtgtgtatgtgctggaaaataataataaatatagagttaggtactatctgcagttttaggcatctactaggggtcgtggaacatatcccccatggatgtgggggttgggggttggggactactctaatcaggccagttactaaaaaaataaacaagcaaataacaataacaagtccaagtgggaggcagaataatcagtacttagagttgctaaaatatatcatctgaaacatcctgtttccaacaaaaacttataagccatgcaaagaaacagtaaagtgtgacccctcagaataataaaaaggcaggtaatacaaactgtctgtgagagaaatcagagattaaatataacagaaaaagacttcaaactagccatcatcaatacatctactgaactaaaggaaacataatgaaagaaacaaagaaaggtattaagataatgtttcattaaatagaggacatcaataaagagagaaattagaaaacaacaaaaaagaccatataaaacttctagagttgaaagctgcaatagctaaaataaaaagttcttttgagtggcttaagagaagactgcaactgatagaaggaagaaatatcaatgttacaaaaggtagtaaggcagacaaaagcagggcaggagagggtcccccaccaccagaaatgtcaggcaaccatcatgtgatggtcaggcagttattaaatctctctaagacaataattggtcacagctggcactagggaaaggcagtcttctaagagagagaaacatctgaaactggtgatcagcagcttcctgataagatctcagaagccgggcaagtgagcccaagcatgcacacaaagaggcaaaatggtggagtttaactggtatatgaccctctaggaacattccgattggtaagagaagaacgcctcaagtgagcattcatacaactccagtaaacacactgcacgcagacagcccacccaagggaagaatcaggggagaagtaatgcaagaccctagaaacatgccaacatatgaaaccccaagtcaaaatgtcgaaccatgcacttgatcactcaagtcatgcacttggccgtcttctatgcgtagttcacttctattcatgcctgctctaaaactttttaatgaactttcgcttctgctctaaaacttgccttggtctttcactctacactctaccttatgccccctcagtcgaattctttcttctgaggaggtaagaattaaggttgctacagacccatacaaattcaccacctataacaccaacattgaagacaaatagagattatggaatatgaatgtatgaatttatactcacattactataaggaactacctgagactgggtaacttataaagaaaaaagttttaattgcctcatggttctgcaggctgtacaggaagcatggctggggaagcctcaggaaactcataatcatggcagaaggggaagcaggcaatttcttcatggtagagcaggagagagagcgtgaaggtggaggggctacacacatttaaacaaccaaatctcgtgagaattctatgggatagcactaggaggatggtgctaaaccattaaaaaccacccccataatccagtcacctcccaccaggccccaccttcaacattagagattataattctacatgagatttgggtgggaacacagtgccaaatcatatcaatggagaataagaaaaaaaaagaatgaagaaaaataaacacagactcagataaatgcaggacaacatcaagcaaaccaacacgtatataaggggcatttctgaaggacaggagaagagttaatagtagaaaaaatattctaagaaataatggcagaaatcttttcaaatttatttaaaaagcaacagcctacatatccactatatttctgccatgcttcatgagcacatggctgcaggaacacaacaaattatttcatcctttagtaaagacataaaatatcataatacataacattttaattagattactaaatgtcagtttacaaattaggtttctatagaataagtgagcaaataaagggataactgcatggataaataagtagtaatgaccccctcattcaaacatgcttgcatatacttggcagtccagactaatttttcagacctgtcaaaagcaaaataaattactagatatcactgccttatcaaaggtaactgacatgggcaagattagaatagaaaaacagtgtgactaaaaccagccactgaaaattgaatacgctgacattaacacaattactatgtaaattggtgcttggaaatgacttatacatatatgctttataacatgtttgtcactacccaggtgccaagttgacattttattcttctattgagaatgggaagagacaaccttaaatgaaccaaaatagttttgcaagaaatcatgcagtgacaaaaggttgaaagaaaataatttgctatctttctaaacatgtcagatcctttatatcgattttttaaataattggtttgctaactataatattattagctattctgataattatttttaggagatctggatttcacagaatttaactacctgaactgtcatctatcagtaaagccatgttacaaggcttttagtagactagtaggcagtaaattaaccaattaataaattagtatggagtctaagttgctggcactgttatttataaaggtgtctaaaacaccatttttgctctagccatgaggtcagaaacaagttctagtattttgaattggtgtcctttccacacagaccctaataaaactgactgtaaatgagttgacactccatcactatttcagggaattcctttgattatttcaaaatggcacaaaatcataaccatttagactatgagccataaaggaatctcagaatataacttgctgcctgtttattatgattattactatatgttaactcatttaccattatatgagaaatgttccaaatgtcatattttacatgatgtgtgtgtgtatgtattcattttaatctgaaatatgttaacataattaaggaatccttaaaaatacactgtcacttcattcttcagattatattatcaggtaaagtacgttgaataatatgatagagtcagacgccaatgttacttgaacaaacttattaatgaatgttaagaatatatttgaagccaatcatgtaaagtatttattttctgatattactttaaaaggaaaaaagaaataaattcacttaattttgagggctctaagagtcatgactttaaatactaagcttaaattttcctttttgaaagggcagttttctataaacacatattttggaaaatttaatagttctcttagtaattgactgaaatagaccaaaaaattaagtcggaatataggagatttaaacaaaatcaccaataaacaggcttaatttatatttatttatatttattggctactatatttaataatggcataataaatattttttcaattgtacatagaatatttaccaaaatagaacatatgccagtacataaacaactctcaataaatttcagtggattgaagtaatagagtattttctttgaccaaacttctattaaattattaatcaaaaataatatacttataaatatgcaaatatttagaaattaaatagcatttataaaggactcatgaatcaaatataaaactatatagcttagaaaatatttcaaatagaatgataatgaatatacatcccaaagtttgttaatatgctttacatataaagtgctccttataggtaaatgtgtagatttaaatgtttaaatttgtaaagaaaatttcatttagtaaagtaagtacaaagaaggaaataaatcaatgactttgtcaaaaagaagaaaaaataataattcaaactgtaatactttgaacagattaattaaatttctaaattccaaaaagtatttctaagaaaaaaaaagagaacaacacattattatcaattatgaaacatagacatcattaaactttcaacaagcatttaaattataatgaaggaatattataaccatcatgccaatatatttgacacttagataaaatataaaattttatttaaataccaactgttgctgtcacaaaatgaagcagaaaattcaaatatctgtggaactataaaacattaaatttgtaattaaaagactaccaggcaggttctgatttctgggtaagatgaaagaaacacatgcttctctcattctcattgaactcaaatgtaaaatctaggcagagttgtggccccgctgattgaaaacactggaaaaaataaatagcaataggtggagaaggaaaagacatgagaattcaaagtagcagtgaaatgaggctgtgagcctgagttccttaaaataatgtttgacagttaaagcaaaacaacatttcctgtaattttcaatgtacctaaatatatgagacaactatcaatcacttaggggagtataaaataatctatatggtaatataatttcaatgatcaaagtgaaatggtaaaatactcattttaaatacactggaaaaatgaagtatatattctttatttcctagaacaatcactaaaatgttatgcaaagattaaaatcacaatggattcatagaaatggaatactaaaaaatatatataaatacccaaagaaagcagaaaaggggaactatttgggggaataaaaaaagaaaactaaaagaaaacactccactctacaatagcagagtttatattcttctcatgtgcactatgaaatatttatcgaaacagaccatatcataagttatgaaacaaatgttaatgagttgaaatcttacaaagtatatcactgatcatagaattaaactaaaaatcattaacagagggataacagaacaatctccaaaaacttagaaaccaacacatagtttaataattcatgcactgaaaaggaggtttcaaaggaaattagaaaatatttttaaatgaacaaaaataaagttatacataccaagttatctacgtatatatagcaattttaagttttataattctatgtttataaaaagagaaaaaaccctcaaatccataatttaaggtttcagtttaagaaagcagaaagagaagagcaaaataaattcaaataatatcttactggatttgtgaaattatctgtatttacttacagttctatcaactttcgcttcatatttttggaagctttgttatcgggtgcataaacattttggattgttatgtcctcttgaggaactggcctctttaacatgagataaacttttatatcctagtaatattctttgctttgaaattcattttattacctactaataaagtcaatttggcttttcaaagtagtgatagcatgacatatcttctgtacatttacttttgaacttatttgtgtctttatattaaaaataagtttattggaggaaggaggtggcgatctggcaatctctgcctttatgagtttgtttagactacttatagtcaatgtgattattgatatgttgtcttaaatttatcatattaatatagcttctctatttgtattatttagtctacttttttcctctggctttgccttcgtttggattaattttatatttctaatcattctatttcacttttttgaggagtaaagttgatataattctttttgtgttattttaagttgctttagggtagataaaatatgaaattatattgatctatctttaaacaatgttacctgactttatttatagtataagtatttacaacagtatacatccttgtctccagttctggcctttatgctattattgtgaaatattttgcttctatttatattataagcctaaaaatataatactatcatttttgctataagctaatcgattagattaatatttttaagtgaatagatactaataaaagttactttaataactaacaacataattatcttttctgttgcttttttatttttatatgacctaaaagtcattcaggagcaggttaatggccatgtaattgcatggttttgagaaatattttttagttttgatttttatatctattgtgctgtggtccaagagtgtgtttcatatgatttcagttcttttatatttgctaaggactgttttatgtctgattatgtggtcaattttagagtgtgtgccatgtgcagcttagaaaaatgtatattttgttgtttggggtggagagttctgtagaggtctatcaaatccatttaatccagtgttgagttcaggtcctgaatatcattgttaactttctgcctcagcgatctaatattgtcagtgtggtgttgaagtctcccagtgttattgtgtgagagtctaaacctcttggtaggtctctaacgacttgctttatgagtctgggtgctcctgtgttgagtgtatatatatttgggatacttggttgttgttgaattgaacccttcaccattatgtaatgaccttctgtgtctttttttgatatttgttggtttaaagtctgttttgtctaaaattcgcattgccacccatgttttttttccccattttattttcttaggagattttcctccatttctttattttgagcctatggatatcattgcatgtcagatgggtcttttgaagacagcatatcatctggcttgctttttttatacagcttgccattctctgctttttaaatgggggcccatttacattcaaggttaatattgatatgtgtcgatatgattctcattttttgttagcaatttattatgccagcttgtttgtgtgattgctttatagtgtcactggtctgtgtaatgatgtgtgtgtttttttattggctgctaacaatcttcccttttcatatttagtgctcttttcaggattttttataaggcaggtctggtggtaatgaactccctcagcatttgcttagctgaaaaatgatctcatttctctttcactgaggaagcttaatttggctggatatgaaattcttggttgaagatttttttttctttaagaatgttgaatatatgctcccaatctcttctttcttgtagagtttctgctgagaggtctgctgttaacctgatggggttccctttgtaagtgacctgcccttttgccctagctgccttcaacattttttctttcattttgcccttggaaaatgtgatgattatgtgtattgaggattttcttcttgtgtagaatcttgtagggcttctctgtatttcctgaatttgattgttggctcctctagtaagattctggaagttttcatgaacaacatcctgaaatatgttttccaagttatttgctttctccccttccctttcaaggaggccagtgattcctattttaggcctttttacataatctcacatttcttggaggttttgtttattcctttttatttttcttctttatcattgtctgactgtattatttcagggatccagtcttcaagttctgagattcattcctcagcctggtttattctgctgttaatactggctattgcattgagaaattctcgtagtgtgttttttcatactgggtgttctatctttcagctcctgtgtcatttcgttgtgattcttattttccttggattaagtttgccattctccagaatcttgatgatctttgttcctactcatattctgaattctgtttctgtcatttcagccaactcatcctggttaagaacccttggaaaactagtggagttgtttggagaacataaaacactctggccatttgagctgccagggttttgggttggttctttctcatctctgggtgggtgttcctttaactgctgggctgcctccgaagtggtcaagcaggggcagggtggttgtactggaatctcaggtcaggcagccctgcccagtgaggaccaggacctacatggagaacagtctgtccattttttcttgaggtgggtgctctgtgttggtggtccataccagcctctggaccctgtcgattctacagagcctggagacagcaaaggtgagggctgcaagacagcaaagatggcaacctgttcctcttactgggagctctgtcccagagagttgcagagctgctattggctaatagccccagcagggggtggctggagacctaggccaggaggacccacctagtgagaagatacaggatcagggaaccatgttacaaactgtctggacatttttccatagggctgctgccatatgctgggtgtccactctagtccctagtcaccttagattttccagcacctaaagatatcaacagtgaaggctgcaaaagagcaaagatggctgcctaccccttcttctgggtgttcatcccagaaaagtatgaacctgttgcttgcctgaaccactggcagggagattgtagacctcagtacagagatcccacccagtgaggaggaacaagatgtgtgacctgtgtgaaaaagcagtctggccacttctctgtagagctgctgcactgtgccaggaaactgctccagtccctagtcacctcagaccccctagagcccgaaggcaacaatggctaaggctgtgaagcagcaaagatggcaacccatctgtccccctgggaactccatctcagagaagctgggaaccactgaaaggtgggaaacactggcaagggtggctagtgaccccagccaggaggtcccacttactgaagagaaagcgaggtcagggatcccagtctggccacttttccacagggcagctacactgagggcaacaacagctaaggctgtgaaccagcaaagatggcagcctacccctccctcttgggagctgcatctcagggacgtataacactgctactggtggctggctggagttccaagccagtgagtcttatccttcaaggtgcagtggaaacaggatctgcagaccattactgctcaaccccgaggattcatccccttttctaggggtgtgtatgggagtgtaaactcctgttttgctggagttgcaaccgcttttgctgagaagcccagagctgggagcttccagggctccacctgtgcctgagcggccactaagccaagactccatgtagctctgggtgtcagactgcaggtcctggtggaggggattcatgaggggatctcctgacccatggtttgcaaagatccactggggaggtgtgggtccccggagctgctaactcacttatcacttccctgagctagggaggctcccctggctccatgttgctcctgagtgggcattcatcttgccttgtttgtctttgctttccgtgggttgaattctcttcttgatgaatcccaatgtgtgtacctggctatttcagctgaaggtgctgtatttacttgtgccctctttttctctccatgagagtagcccacactagcagcttctagtcagccatcttggccagctcccaacatcgttgttttatcgctcattttaacaacttaattttgataggaagtagtatagtttatttgtttttttgtgttaagcttcactgagcttttgaagctcagcgtttaccaatttcattaaatttggaaattttccatttcttcaaatgtgtcttgtctctcttcccttctctttggggcactttaagtacatatatattaggcctcttgaagttgaccccttgctgctgacttactgttagttttatgttcagactgtttcttttttgtttcattttgggtagttctatttccagatgttcaagtttactgaccttttattctgcagtatctgatcagccttaaattctaaccaacttattttcatctctaaaagttgcatttggatattttaaatatcttttatatatcttaaattcaatttttcattatcttcttgaacataaagaaaacagcactaataactttaatatctttgcctattaattatattatctatcatttcacttaattttttctcattgttagttcattttttgttcttttaatggttgatttttaaaactttattttattttactctcatcagaacacttaatatgtgtgtagatattacacacatattacaaaatgttcaacatcttgtaaaaaaaaaaaaaagtagtttttgttttgttttgtttttgagatggagtttcactctgtcacccaggctggagtgcagtggtgcgatctgggctcactgcaacctccacctcccaggttcaagcaattcttctgcctcaagagatctactcttagaagtaaatttttaagtatacaatacattattgttgattatgggtacaatatcatacaacagatctctagaacgtattgattttaactggctgaaactttaggctggttgattagtagcttcccagctcctgtccctctatccactggcaaccattctactcttttgttctatggatttgattattttaggtacctcatttaagataaatcatgcagtatttatttttctgagactggcttatttaacttggcataatattctcaagtttcatccatgttgctgcatgttgcagaattttcatctttttaaggcttagtagcattttatttatgtatataccacattttctttatccattcatccctcaacaaacatttgggtttcttccatactttagctgttgtgaatagtgctgtaataaatataagaatgctaatgtctctccaagattagttacttttgataaatccccaaaaaagagattgcaggatcatattttagtactattattaattttttaagaaatctctatactgtttttcatagtggctgcaccattttttattccccagactaaacagagtgtaagggttctaatttctacactcttgctgacacctctcttttgtttttttgataatgacctttctgacaggtgttaggtgaaatctcagtgtggttttcatttggattttactaattagaggtgttgagcaatttttaatatgccagttggccatttgtgtgtcttccttggatgaatgtttaagtaattatctcatattttaaaatctgtatattttatttttttaatatttactatttttaatttgtaaaaatttataggatataggagaaatcttgctacatatatataaggcataattatctagtcagagtgtttacagtgtccgtcacttgagtgcaatacatttttaagcataggcaccctactctgctatcaaacattgaatttatttcttctatcttactttatgtttttatcttttaacccagttcttttcatcatccctcctaaccctggctcccaactgaaccttcctagtccttgttatctactttacactctctatttccatccgatcaagtttttttttttacctcccacatataagcgagaacatgtgaaatttgtctaccttattttaattaagataatgaccttcagttttatctgtgttggtgcaaatgacatgattttatttttttctggctgaaaaatatttcattgtgtatatatactatattttcattgtccagtcatctgttcatgaacactttgcttgattcaatatatttgctattgtaaatagtgctacaataaacatgtgagtccaagtatctttttcatatgttgatttcttttccgttgggaagatacccagttgtggtattgttagatcaaatggtaattctatttttaattttttgagaaatcgtcatactgttttccatgctgactatactagtttacactcccaccaacagtgtacaaaagttggcttttctctacatgcttgccaaaatctgttatttattgtctttttaataatcaccattctaactggggtaagttgttacctcattgtggttttgagttgcatatctctgataattaatgatgatcagcctctttttatataccacttggtcatttgtaagtcttcatcttagaaatgtacactgatggccgggtgcagtggctcacacctgtaatcccagcactttgggaggccaagatgggtgtatcacctgaggttgggagttcgagaccagcctgaccaacatggagaaacctcctctctactgaaaatacaaaattagccaggcatggtggtgcatgcctgtaatcccagctactcgggaggctgaggcagaggaatcgcttgaacctgggagatggaggttgcagtgagccgagatcgtgcaattgcattccagcctaggcgacaaaagtgaaagtccatctcaaaagaaaaaaataaaaacaaaacaaaacaaaaaacgaaatgtacattgatgtcctttgcccacattttaatataattatttgtttttctttttgttgagttgagttccttttatattcttgatattagtctcctgttggatgaacagtctgcaaataatttctcccattaaacagttcttttaatttaacagcctctttttctgttaattgttttcatttaacagcctctttttctgttaattgttttcatttactttgctgtgtagaatatttgtggtttaatatagtccctcttgtctattcttggttttgtcacctgcgcttttgaggtcttagtcataaattgtttgcctagaccaacatccaagggagttttcccaatgttttcttctaatattttttatagtttgggagcttatgtttaagtctttaatatatcttgagtttatttttgtatgtggtgagagataggggtctagttttattcttctgcatgtggctacccaattttcccagcaccatttattgaatagggtgtccttttcccaatgtaagttcttgtcaactttgttgaaggtcagttggttgtaaatatgtgaccttatttctggattctctcttttgttccattggtctgtgtatctatttttataccaataccagtgctatttggtatgggttacgataccttggttactacactttactctactctactctactctactctactttggttactatagccttgtaatatattttgaactcaggtcatgtgatggcttcagctttgttctttttgcttaggactgctttggctatttgggctctcttttggttctattgaattttaggactgctttttctaattctgtgaaaaatggtgtcggcattttgatagggattgtgttgaatttgtaaattgctttggacaatatggtcattttaatgacatcaattcttctgacccataagtatagtatatttttccatttgttttatcttcagtttatttcatcagtgttttgtaattttgcttgtagagatttttcacatctttggtaaaatttattcttagcatcttttttacagctattgtaaataggattgccttctcgatttcttctttggtgtacagaagtgctactgatttttttacattaattttttatcctgaaactttactgaagtcgcttattagttctaggagctgtttggcaaagtctatagggttttctagacatgtaatcatgtcatcagagaagaaaaaaaatttgattttatcttttcatatttggttgcatttatttccttctcttgcctgattgctcaggataggacttccagtacatgttgaaaaggaatggtgagaatggccatccttgtctttttcctgttcttaagaggaatgcttctagcttttgcccattcagtaggatgtttggctgtgggtttgtggctcttattattttgaggtaagttttttcaatgcctagtttgttgaaggtttttattgtaaagagatgttgaattttatcaaaacctttttctttgtctattgatataatcatatgactttttttttttttttgagacagagtctcgctctgtcgcccaggctggagtgcagtggcacgatctctgcccactgcaagctccgcctcccaggttcacaccatacaggcacccgccaccacgcccagctaattttttgtatttttagtagagacgggtttcaccgtgttagccaggagggtctccatctcctgaccttgtgatctacccaccaatcatatgacttttgtgtttaattctgtttacgtgttgaatcaggtttattgatttgcatatgttgtactcacattgcatcccaggaataaggcctaactgatcgtggtgaattaactttttgatgtactgctgaatttagtttgccagcattttgttgagaatctttgcatctatgttcaccaggaatattagcctgtagttgtctttattcattgtgtctttgccagatttaggtatcaaggtgatgctagctcgctttgtagaatgagttagggagaggtccctcttcctcaattttttggaatagttttagtagaattggtaccagctcttctttgcacatctggtagaatttggctgtgaattcttctggtccagggcttttttggttgacaggttttttattgctgaattcaaatttggaacttgatattggtcctttcaggatttcaatttcttcctgattcaatctggggagcttgtatgtttccatggatttatccatttcctctaggttttccagtttgtgtgtatagatgtggtcgtattagtctctgaggatcttttgtatttctgttagatcagttgtagggtcatctttgttgtatctaattgtgcttatttgaacctctgttttttctttattaataaagctaatggtctattgatcttgtttatcctttcaaataatcaacttttggttttgcgatcctttgtataaatttctgagtctcaattttattcacttccactctgattttagttatttattttcttccacttgcttcacggttattttgtttttgttttgttttctagttcctctatgtgtgatgttacactgttaatttgagaccattctaacttcttgacataagcctttagtgctatgaactttcgtcttaacactgattttgctgcatttcaggatattggtttattatgtctctattttttatttcaaagaattttgtttatttatatcttaatttatttgtttacccaaaaggagcaagttgtttaatttctatgtagttaggtgtttttgagaactcttcttggtatagttttgttttgtttttttttttttttgactgagtctcactctgttgcccaggctggagtgcagtgactccatctcggctcactgcaacctttacctgccaggttcaaggctattctcctgcctcagcctcctgactagctgggattacaggcacatgccaccatgcccagctaatttttttttttttttttaagtagagaccgggtttcaccatgttggtcaggctggtctcaaactcctgacctcaggatccgcccacctcggcctcccaaagtgctgggattacagacatgagccaccatgccagcctagatttctatttttattcctgtggtccaaaggtatggttggtatggctttgatttttttgaatttactgagaattgcttcatggcaatgcatgtggccagtcttggaatatgttctgcatgcagacgagaaaaatgtgtattctgtggttgattggtggagtactctggggatgtatatcaagtacagtttatcaagtgttaatttaagttcagaatttctttgttagttttctgccttatagatgtctttaatgctgtcagtgaggtgttgcagcacccctccaccccgtccattattgtatgactgtgtctttttgtaggagtagatatgtgttttataaatgtttgtgctccaacattggtacgcgtatatttagaatagttaagtattattgttgaattgaagtctttatcattatgcaatgccctatcatcattatataatgtccttctttttcccttttttgctgtcattggtttaaagtctgttttatctgatacaggaatagtgacccctgctcttttttgttttccatttgtgtaatagatctttctccaacctttcactttaagcttatgggtatccttacatttaagatggttctcttgaagacagctgctggacgggtcatttttttttttaatccagcttggcaccctgtaccttttaagtaggaccatgtaccttcaaggttacaccatgtacattcaaggttaatgatgatatgtgaggttttaattctattgtgaagttaactggttgctttgtagtttctactgtgtagttgcttcatagaatctatgggctacgtacttaagtgtgtgtttgtggtagcaggtgtaattattttgtttctatgttaagaactcctatatggatcttttataaggttggtctattggcaataagttccctttgtgattatatgtctggaaaatgtttctcttttgcttaaaaagcttagtttagtggtacattaattttttttttaagagtgctggctataggcctcaatctcttctgacttacaaggtttctactgggaagttgctgttaacctgacttttcttgttgttgctgttgaggatctgaccttttactctacccgtctttaaggttttttgtttttttttttctagtgttgaccttgatcagtctggtgattatatgcctggtgatgtttattttgtatagtatcatacaagtgatctctggattcttgcatctggatacctatttctctagcaaaattagagaattatttttgcattattatctcaaatatactttccaagttgtttactttttcttcttctctctcaggaatgccagtgattcataggtttgattgctttacataatcccatgtttctcgaagacttaattcattttctaatttaaaaaaaaaagatttttgcttgactaggttagtttgaaaacctgatctttgagctctaaaattcttttactgtttggcgtaggctactgatgaaagtcttcaactgtattttgaaatacactaagtgaattttttaattctagaagctctggttatttttttaagatgttaatctcttccttcatttattggctttctttggaagtttatttgtgttgattttcaaccttgtcttgaatatcattcatcttccttgcaatccaattctttatctgccattttggggtttctattttggttagggaatattgctagagagtgagcgtgatcctttcatgctgtcacaatgttcagatttttttttttctggtgcccaaaattctaatgctggctccttttcatctggagatcctggcacttctaatttgtgtaattatttttgtgtgaatcggattttttttctctctttccctataatgttgatttctgttctttccctctacccccttcctggggggtatgactgtagagaatgttggatagggtcttttggctttgtttcttcacccaacttctgttgggtggttttatattgggccatgcagttcaagctccgggccagtagatatcacttctgggtaaaagccagctgtggccaatgtggctgggtacatatatttgaaccttgtttactgcgagatattgcctgagacaatggactgattcttggaatacataatggcctgagctccttgctcagctgtaggggtgagccaagatggacaggggcaagccaggcaggtctgcctaaaggttacctgaagggagaattgagggcgcagccaccaagcaccaagaaatgtgcctacgactggcgctgggaaacctcttgagtggtaacttctctgcccagggagggagggcagcctaaactcctaatccaggagagtggatgttttataagcttggagatctgtccaggcatggaggggagagggcctcacttcacatggtctctccacagaaatggtggacactcaggctgttgatatgggtgagtgagtgctctgaatgcctggagatctgcctgggcataaaacagagagtgctttgctgcactgtggtctctgcgtaagaacgatgggacagatcagactgttaatccaggtgagcatgttctctgaatgtctggagatatgcctgggcatggagtagagaggacccctctgtaccttcatctcaggggagcaggctggggcacccagcaaacacacacacacaccacacacacacacacacacacacacacacacacacacacacacacacacacacacacagagtttccaggtcaccaagttggtttcttctcacccaggagaaatcatggctacagtagttcttctcttgccctagacctgtggcaaggggagggtacaattccagtgcctactcctggggcactttctacatttcctgctcaattctggctctggaggctcctaccaaactccagagcaagcactccaatcgctggcctgagactaaaatacctgtgtagtcacactgttgggttgccgaagagtgactgactctgtatgctcctggattaaaaatggcatcctgctttcaactccagtcggggaaaatgctgcaacttttcccaatgtctttccctctgagtttctccaagcctctccccaagttagctccaaagctgggagaaacaaagggctctcccttggcctggacaaatccccagtggaaaggtgagtcacaaaggaaaactctctgcccctctcatgtattgagacttgactcacttttgacagccagatgctgacacgggggctgtttgcacatggtcttctttttgggatctggggtgtccttcacaattccagtagattcccatttttcttcttgaattaaagttcacagcattgatctttatgcactgttttgctgtttctctgtggctgaggccatcttgaaacaacaacaaaactttcttttttatattgaattgttctagctaggattgataatcctatgttgaataggagtctcaaaattaagtatctttgtcttgttcctgatcttagaggaaaagctttcaatttttcataattgcatataatattagctgtgggctttttatatatggcatgtattaagttgaattaattttcttttatttctagtttgtgagagtctttaacttaaaaatgtgtctatttcgtcaaatactttctctgcatctattgagatgatcatgtggttttatgattttattttgttaatatagtgcatcacattcattaattttcatatattgaaccacccttgcatcccagggataagtccagcttgattatggtgtatgatcattttaatgttctgttgaagttagtttgctggtattttactcaggattcttgcatctatgttcatcagagatattggcctatagtttttctttcttgtggtgtctttgcccatctttgacatcagggtagcgctggcctcataaaatgagttttgaagtgtatggttgtcaatttttatttggtatcagacattgtgattttaccttcaaaggtgaaaaatattttgtattactataaatattattgagctttgttacataatgaatttaagttatgtgaaaacagtttgatactataagatcttgcttttaagctaagttggatcagagctatatttaggctagggataatttgccaccctgctgagataaaacccgtctaactctttccatactccacctaattctccataagcattagtttttaccctatatgaatgataggtattgtttcctctaatccattcttgggttttattctccagataagggttgttcctttgtatgcttgcactgatcagcgcttagctgaagatgtgaggaggactctgcagatcccctgagttctgtgtacagctcattcctttagagtgctctatcttgcaaactctagccaccttggtcgcctggactcttggctccattttcttatcttagggagatcatttggatctgcctgtgtttctcttaaattcaccatgccctggaatctcaggctagagtgtaagcaggggaaattgtatcctgtttctgaaagccactattgtttgttgcttgatattcaatgccttgaaaataattgtttcatattcaaaaatgtagttgtcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaatgtagttgtttagttggtaatatggtttggctctatgtccccacccaaatctcatcttgtagctcccataattcccacgtgttgtggggagggacctggttggagatgatggaatcatgggggtgggtctttcttgtgctgttctggtgatagtgaatgggtatcacgagatctaatggtgtgaaaaacaggagtttctctgcacaggctctccttttgcctgctgccatccatgtaagatattgacttgctcctccttccctccctccatgattgtgaagcttccccaaccatacggaacagtaagtccaattaaacctctttcttttataaattgcctagtctcgggtatgtctttatcagcaccatgaaaacagactaatacagttgaatcaagtagaaaggtaaatatggtccttattagtacatttgactaaaaggaaatctcaaatataattttacctagacataatatttgatagaaatagcaaaaatctgtattattatttaaatatgcaaaaccaatataggaatattgtgcatagtggacactatttctacttattttagccacctgataatataatattagtggctgttagagcctctattcacatgacagttcatcataaattttttgtgatgggtattttgtcacacattttattgaacggtttatctacaaaaatatttatggaggatagagcatacatctcacaaaaacgtttgagctaatcaagtaattgcctacccctccttaaaatattatagtatttatataatttaattaatttaattagtataaagatgccttaaagggccaatgatagaatgacatttccaaaagattatgtaatcaaaagtgaagaatgctggattcttattcgttgctcgtgttacctcctgtgtaggctataattactgaattttcagaaaagctataaacttcttagttcaggaacagtgcctcatcattgtatcacttttttacccagtacaatgcctttccaattagattgtaaaataatttatgtttaactctctaaaactctgtctcaattctcaattaaatggggggcttaactggatgatttcttaaatgtggttgcagctctaatatcctctgttgtcatgcttctatggatgtgggactgtaaatattctgtttttcatctgtgaagaaattgaatctctttcatttttccattaaattttgtccaacaagtaaaatgttcttttcttgttttgttctaaagaaggcagaagactaaaatgattgatttcgctagtgtcatttgccaaatgtttctgactctattccttctgtacaatatgagactgcacattctaggcccctgggctgcatgactagttctgaccaatgagctgtaagcagacagcaatgtgccattttagggatacatcatctaattactagcttgatacccatcagtgttctcatttatatctaccacaatgattgacagtgatcaagatgttggctatttctgctaagcacagtgagcagagaccctccttccaactagtgttgaacaggtaaaggaagcaaaaaagggaatagttattattttaagtcattgaaatttgggggtggtcattaccaccatataacctcctgactattgttataagtaaaacaaaaaacaaacaaacaaaacaaaacaaaaaataaagccatactttgaataagctaacagaatgatctaaagattgaaatattcaaacattttactcaaaagctgcaatcccagagttagaactttttaaatgtgagttgtaacaccctttccaaaacaaaatacacaacaataggcagcgagaagtaatgtttaagtgatggtgaagaatacatgaaagttttaagatctccaaatgaaaattaacctaaatgcctgtaatataaacattgacattgttgcatatgtactaaagtatctcttttagacaaaaataagtcactgataagtctggtacttatttcaagtatttgtaattaaaatttattttgtggccttttttattgttgaaaaaaccacttattttaataaaatcaatgaaataaaaaagataaattagtgtaaccatgaaaagaataaatgttaagtatgtgttaaacaatactgttgaactgtattttaaaaatctctcagtttagcaaatgccaatataaaaaatcagaaaacgtttatgtattctgttttggaaaaacagaagaatatgagaaaatttgccattgaagtttcattactgtgaaagacttagcagaatgtttacaaaataatttggattttttttttggatttttaaatgccttcacgacttgtcatttctctcaagtaaatttttaaataatttaaactatttcttttgtcttcttggtgcttttaaaatttgaagaattagtttttatccatttatataaactgttactcaacaaagagatgtccttacctctgagccattcctaaactgcaaggtaattttatgcaaatgcttatctgaaaataatacagcaataagaaatgcagtaattacacccatattcctagaaacctatttcaacacgttttagtttgtccctattttcttattctatttgtgaatttgctgtgcatttgtaaccataaaaagcatacaaattgtgtttgactttattttacttattaaagtcagttccatattggtacatcatcttcatatttgtaaacttttattctcaacctgacttgacattaaacctaaaatatgcaggtgcagagcctaaataaagccctggatgtgcttcactatttctagtaatactatagggcagtcatctggatcacaacttcttgaatccaatgcctgagcttggcagtgattcaatttttctttggagcagctcaagtgctagaatgaccgaataaaattcaatcagattaagtgcttttacaaaggagctggctttccttagagtgaaaatcagatctgcaccctcattattttttgctagaattattacaagggctaatctttctgcttctactctttgccatctgcaacacattgtctgccctgctgccagaggaatatgtaaacacgatccggtcttgtgattaacaatatttgaagtacttcatgttgactgcaggctaacatccaaattccttagaatcattttcaagattcttcatgatctgttctcaatgtacagactcattgataaagacgtccttaattctatcagacaaagttagtcacacttccttcaggctctcaatgtctgtgtgccatctattatgtcacttgtcttgtttgagtctaatcattttatatatctgctcactggtctgtgaacccttaagggaagagactgaaatgtattcatctttgtatcctaaatgtctctcactgtctcttctgcagttcctgtctttcctagttccacgtcttcttccacagaggatttgacaatgaaataatacagtgtaaacaacaatgaccgtaataatgacagtatttattaaacccctgctattattagatatgatgctatatgaagtacgttacatagatgtcccaattaattctccttagcacattatgaagaggtattgtttttttttttttttgctcccacattatcctctgtgagaaaattaatcttatagagggtaaataacttgcccattgtcacacaggcagtaaatggcaaagctatcatttgaacctagtctgatctataaagtgtggtgtgactttccaatatttgatacataatcatcaggcatgaaatagtaaggagtttataatgtagtctaattgaaaaataagttacagatatcaatgtaaaaaggcaatgttactactaataatcaactaattaggatgagaccatttttatgtatccactgtaatgtcttgatagttgtgtttcataggcctagagatgtctctgagtagagcaccagtaataattcaaaagctgaaagaagtaatgaaatgcatgtgtgataatcgttttttaaaaacttatttaaaagtatttccaagtataacaaactgcagccttcctaactgaacataaataagagtgttgcctatttgaccagcacattgatcaaagtgaatcttgaccagggtattgatttaagagactgttccaaagagactataccaaatgaggtataacttatttgcctatgtctaagtttaggttcctctagaagcaaaccctgaaacaaaaatttgactataatagtgtttaggaggtaatcacagaatgtagagtggtgcggttcagggaatgtgagaaaggaagacagaaaagggaaagtagccagtaaaagatgcattgtcaaactgctgatcactgtgggcaaccgaggtgtaatcctgctaggaaactatgggagacaatatggaacatacctcagggttatcccaccatacgactatttattctctaacttccattatttgttggttgatacttgttctaggggaattaatttttcccagaacttctgatctgccctttgtgcagagatgagagaaagtactcactttgctatctgcagagatgtataataggaccctcttggcttatactggaatggtgagtgctaaggagacattgatgtgccagcatcatctgctagagcttatctctcatgagcctgttcctccagcaaaatagatttttaccttgagctacacacccacatatatatagatagacatataaattgacagatagatgtgtatatgatatatgaaagctacgttccaactggatgtcgttttgacgtctcaacagtacatggtcaaaattgaattcattatcgttgctctcattatttgaaaccttcaatatgtccctcacacaggctcctatgtcattctgtatttcatctgatcagttgcccatgtccaaaacgtaagagtcctctttagtcacttctcctagttaccaagtcgtgtgaattctctttctacatagatcttgaacctgtcctctgcaggccaccttcaattctcacttgaatttctacaacattttccaaattggcttatgggcctctctcaaataatcttatagcactctattaatcttctacactatccatttcattttaaaattgtaactatttgtctttctgtatctctcattataatataaatgtcttgaagttcagaactagattttgttcattgttttatctcaactttggagcctggcctatatcaaaccttcagtaaattactgtgacatgagtgaatgaatgaatgaatagaatggatccttttatatttcatgtgtactagtaatttgatagtaatttgagctcaggcacatagaaattattgaaaacatttcaaaagagaaagcctttgtcacacatgattggtcttgcattcttttttgtctaccctttctctgattggattgtatatgactctgaaaagtcatgagcctattgatttttttcttttcttttgttttctttctttttttttttttttttttgagacagtctcactctgtcacccaggctggactgtgcagtggtgcaatctcatctcactgcaatctctgcctcctgggttcaagcgattcttttgcctcagccagctgagtagctaggatgacaggcgtgtgccaccatacctggctaatatttgtatttttggtagagatggggttttgctatgttgcccaggctgatcttgaactccaggactcaagtgatcctcccaccttggcctcccaaagtgccgggattgcagccatgagccactgtgcctggcccctattgatgggttataggatattactctgaatgcaattcctctttaattaatagacaagtaatatgtacaatagcttgtcctaatgtttaaaaaacaattggcttcattggggatatcaccttcattctaagaacactgtgaagtgtaatggttctcacaagtaggtgcaacattctgaatattgatgtatcaaagcacaattagttgggctctttgactttgttcagaagaatcaatggctctgcataattatgaccaggtatgctgaatttcattaacactattttccagatctgtgaattataagcaaaacatctatcttactacactcccatggaaattactgacaaatctttgtcatattatatatattttttgacatttatcctaaaatgaatttcatgtttttacacatttttgtgcccatatcattataattttgatgggttttcagacacttttcattgtctgaatatgtcaaaatttacttgtttaatgaatattgttaaaaataataaattattaggttaaataatgaataaaggaatacaattttaaaaatacttctttttcatcttctcagatggttccaacaatgaaaaaaatgaacttgagatttctttttagagttttcactgggactatgataacatcttgatttggatcttaatttaatcttattatgtggttgtgctcagttaacagttattttaaattgaattttaatttattctgtttagaagctacagttgtttttcccttcaggctttaaatactgtccagccattgaaacactccatgactaaaactgactaattaaacataaatattacagaagttaaatttttagatatcttcaggaagtccatctaaaccttaattatgtgctccatggaaacagttttaatgcatattactcatccttatttctattatataacaacaggaaaaatgtacatcaacaagagcacaacatttcaaaaactgacaaatttgaaaccctgataccagaggataaaacagttgtttcattaagagtgagtgtgaaaggagatcattaatgcattccgtgaaggagcaggataacaatcatgctgtacaaactctggttggaaagtattagactaagtcgtgtttccacagttgtctgataacataatgaataaacaacagaataagatatacaagagttttgtatttgacacaccattttcttttccctcatctccagctgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagaggtaagatacagttgataacattttatctgattctgctaccattcacataatcattaaggactttttaaaaaagacaatgggagcttctttctgattccatctgaaaggtgattatgaagttttatctatgttgtgatttcgtaaaatattcaccaaatgcaaaagaaacttaatgagaagctataggtttcatttgggaatctgtaagaaatttgcattacaatctctgttgcaaattaggtgttggcaaaatgcctcaaattctactttcagcttcaggaccaacactgtaaaatatattattgtaagtacatatgaatggtaaaatatttgagttagaactataaaatttgttcctatttctgaaaagtatctactctattatttaccagtatgacacatactccaggctgtgcttgtgttacttcataaatattagaaactataagggacacaggtacatatttttacttggtaattctagctattttatctatctgaacaataacagaaacaatctagtgtaatagtatcttacaaaatttagcataagttttaatacttttataattttatatttaccttataaaaattttataattttgtaatttactttctattgtatgaatatactataaagtgcattttataatttaccttatattttattgcacgaaggagctacacttaactgtatatctgttagaaagaatgacagtaaaatattttgattgaatattattcttatgtctcaaaagagaatacaacttgagatcacatgggttaatgaagttttggaagttttaattgaagttaatttgaagttttggaaatgttatttgtcacagaaacatctttttttcatagtattcaaaaattctgcaaaagatagactgcttggtgtgctaattgtgaagtttctttgacagaggtagtcagttaaaatactggtctttatacacttcttttaaatactgattcagaggttgcctagtatctatatatactgggacttacatgacagaaaggaggttgtttgacactacactattaatatggcggagattgcagtgagctgagatcgcaccactgaactccagcctgggtgacagagcgagacttcgtctcaaattaaaaaaaaatatatatatatatattttttttaaactatcaacctggtcattttaggtttgattttaaagaggtttttgtctcgtgttgcataggtaggcatgcatttaatactacctaataagagccactgtctaaaactgaaatttgcagatttttgaaaaacaatgtaaatggcatattcacttttttattctaattgaggttactatttcaaagcagtcatcattattacctcaggctaaagataggtacttaatgtgttaataaaacgttgacttcaaaaagtgaaaaaggtgataaagatctgaggctgcagattgccaagtgaatagtctttgtgattgactggtactaggagaaataggccagtgtaacttttgattatcttggtaaactatttattatagtagaattttgaactggtgggtaatagagtgagaaacacttggtagcagaaaattatggtttgtagaacatttcttgttaaatatttctcagaggtatttttcagttgaaagcctttgaaaaggttgaaaatactggcacctacattttcttggttccaaatcactgtcacctttggtacagtagcaactttggtggactatgtttctgtatgtcatgttagatgggaagaaagtagactgtcaatgtaattagtgttagtgaaaggggataacagaaaatggataatttaggaacagtaatggtgatttttgaatttcctaatggacatttctaaggataatcattactttaacgcttaggtaaaactttcattgagatattctattcttatgagcaatcaaattgaaagtataattttataatcaaatgcaaaagtaaattttgaaagaaataggtgataaaatgcttctataatcttttataatacatcataatttttaaattatataaactaggaaagactctttttccaaatttttgctttggattatgaaaatctcatctgagagtattggttgatgtacattagcacttgagtggacttaggagcatcactcctcctttctgaattatgagaactataaataattaatgtaatgaacacaggtcagaatcccaacatcaactattaagtgtacgacatttggtaaattaactttctctgagtgtctctgtttatcaaaatgagaatgatagtgactcttcatggagaggttatgatggagggccgccatggatgtttcagtgaattgtgtgctcatgggagagcgattgctctcagctattgatttctactcaccaaatactctactactactatagtataaatgtctatactttctggagaagagattctcttaatttaatcaaatgtgatccacaataatctgtctatctatctatctatctatctatctatctatctatctatctatctacctctttactgatttatttatctccagaatcaacagaagaattcatttagtggccatttaaggagttatcatggtaatttatatttggagaaattaggactgccttaacatttaaaacatctccaatatggccaataagctactataagcattgaagtaaaataaaattctgagaatttaatcaataaggagattatgttatctatctaaattatatgcatggccttagaagagtgtttagcagaatccttttcaagattgtttttactattagaagaaaaggaagatacccctagacatcacttgtttacagggcctctaagagagaaaaactttttctactcctttttattctgatgcatctgtagctgtgctgttaaaagctataattaacttatacttttcttagaaaattccccaaagctacaaccctatagtgtgtagagttcttttcaccaactctttaaaaatcagattaagtaggatagataaatttgaaaatacaggaagatataggaattctgttggattcctttaggaagtttttttgtttgttttacactttaaatttacttttagaaatacatcccaatttcatttctgttcagtatttgcactatttaccacctttgcactattaactttttcagatactctacaagatcctttggccaaaagcactaaactttaacaagacttaatcaaatattactcccttatattttacatcctccaggtcaatagaacagctatacatgaacaaaaatacaagaaagccaatattttagacatgtcattagcatgagccacttgctgattacttagaatgcatatttacaacaaatataagtatatagtaattgttaaattctgtaatagtgggtttcatatcaataaagtaaaatactaaaatattagataatcacagaataatgctaactattaccaagtgatttagaaaaatctgcttaaataagattgacctagttctcaaaatgctttaaaaaaagtgcatattccatcttgcagttctcagtttagacattttcctaaagcaagcttggtaacagaatgtcattttagcctcagaacataagtccaccatctataaaacatgaaggtaaaggcctgcaggtaagttttcaacaaccaccactgtgttttgctatctgaagcttaccaaagttagtgaatgtggctattttctttttttccagtaagctctgagaaatacatttaacaacttaacttgaggcctataacaaggcttcatggtgactttaaagcaggactaatcctgggcttatctccaaattccaggcaaccttaacggcatccacatggaaaatgttgaaatgtgtgaaatgggctggggcttaacctcagagatagggtatatttgaacttgacagttccctgaactttgcatgcttagatgaatgcaagtctaaattgaggatagtcgcaggagagttgctgacacactttccttaatgcaagtatggaggcactgctgtatacccgagtatgcacacacaaacagaggcacacaggcgcacactcactcatttctgctcctgcttgtttcaaagttcctggacagaaaagggaagtagttgaatatttgagtttcagaaagatctgttattctccatgtactatttagaaggaaaaacagacttgaaactatcctcccaatgccaacaactttcaagaaatccagcttacttttgcttagacagcccgcactcctactatccaaattgtggtgcatggaccagcagcagcagcttgaagcttgctagaaatgcagactctcagtcctcaccagatgaatcagaatctgcatttcaacaggatctatgtgtactttctataggaattaaagtttcaaaatcactgtcatgcattttaaaattggggttgaatggccaggcacagtggctcacacctgtaatcccagcactttgggaggctgagacaggataattgcttgaacctggaagatggaggttgcagtgagccaagatcgtgccactgcactctagcctgggtgtcagagcaaaactctgtcccaaaagttgaagcttcagtgaataatatgggtgcaataagtaacttcaaaaatctcctgtttcttacatgttattacaaaataaattttgctgtttgtttatactatttagtgtgcaattaatattggatttataagtttgtaaaggacatcgacaatattttatgtaacgttaattgttatatttccttggtagatatcgccattttccaaaaattgtagacatttgccttgctttcttgtgaactcattttatagcatttgatgtttaattccaatttactgtcatacctcatccccttgccaattttccctttttgttaaacaaataatgtctttcaaaactttataaatctattttgctttggaatcagccaatagattttatgccaagttcacaaggaaaaaatattatatatatatatgtgtatatacaatatgtatgtatacatacatatgtatgtggaaatagcaaagcaattcctataatgatccacattaccattaaaaaatcctagacccttcacagggctgaaagtgtttttaaatctttaaaatagcagagatatttttaatgatttcacaaatgatgatgtcaagtcttgaattcaatttctattttacacaaatagtctccaagtatacattaaggaaagtttccataagcagacaaatcaatcagcacaagttttacaactattcgaagttggaagatatcagtgtgaaaaaggttgtaaaaccgaagaagaatggtagtgcctttttattttatattatacaatactaacactaaagtgcatttaaagattctgagacgacagtcgacaaaaatgttttagtgctggtattccatcaggtacttcactagattataagacaagcaatttttatgtctcagatttattgagagctagtcactctaaataaatcttggagttatttagatttaatattcgtatttaaaatggtgaggataattgcgtttaaaaaaatcaaactacaatatcaaaccaaatactgtttagtagcaggaactaagcaaatgttaaaaatataacagtatatttagaaattcaagattatatgccaaagaatggaaaggagctattctgctttctgatatttgtatatcgtgttgcataaaagttaaatgtgcagattgtcctaatggctctgttaacaaattgctttaacatttgtgaatgtaagggaatctgggacattgagcgacattgctctctgtggtcagatgtatgaacataccacagtaatgtgcaatcaatgtcaggaaaattatcctacaacataaaggggtaaaagtttgggaagttacaaaataaaaactcaactcataaaaagtctttgtgcattcgtaaaagatggatattacccaccagtagcagaatatgcttggagtagaatctgtctcagaagaaaagcacttttgagatttctctccctcttacttgtaaattaaaaattcagtctcactggatgttaatgtcttcagaaacaacagaatttatctgacaaaaataatgatagttatatatccttattgagtctcacctttgccttcatgtttatggtagctttgtattgtctcctttttctcctgaagtgcgaatgtgaataatctctcaagtgttcaggaatgctacacacattcacaagcctcatgcttactactacaatactttatttattctagtagaaatctgttttaagcaggtgctcattttgtaaattaagaaaaaggattttgagatactatagaaatatatattttttcttaataaattgcattatggattagcttttataatgagggcattggtagtcagaacattgcaaaaagttattatggagataatatcttctgtcttctaaagaaagtaataatatatctcagttaaaattattttcagtttaattattttaggattcacatttaatttacaaagatatatttgctgaaccatgcaaatagacattttttatgtagctagctttaacaaaaaagaactgttagaagtgttctaatgtacgttgtttgagagaatggcattacgatgaaatacatgcaggctaatttgaacatgcatataagaattttggaaaatatgtgataaaatgaagtgatggaatggaaaggcacaacctaagtttcaatgtctaccctatattaggttgtatcttagttatcacatgtagtattacagcaaattccacagtagaaaaaaatcttatgcttgctttcttttcttttattgtaaaaggtatgatgagtactaaatgaatgaaataagcaaaacatactattactcgattgtctttaaaatgtctatattgaaaagttttctgacttagttaatttggggcttctaaatgtttacatttgtcctatgagtagcttttacattttttaagcatttcattttgaagagatgattaatctcatttagttgtcatttttctaactcacatttcacttttttgcagttttgctctcttctcaaacattagtttgtagtatatgaaattccattttttgtaggacattaatggttgactttgacagttttcatatatttcaatgtttacgaccaagcatcttaaaatctacctacctctggatggaaagtctatcctgggctcatgttttaaactaatacttttaaaggtagagaaaagcatcaggtgttggataagctgctctgactttccaactgctttttgtgtaggaaaattccacatggctgaattaatatgggtttggcatagaaggagacactgcttttagaagcaaaactgttacagctcaccaacgtcacaaaggcatgacttcctcaagaaaaataaattgtgcaattcatttcatggcagattaaatcccatttatttttctttcagacagctgttttgaatagaatgtcaccagtgtgaaaccattttatgcatgttgggcttcagatcttgggcaggcataactttctttgatgaaataaaaggttatgttttatgactattcctcttgtcagcaaacctcagcatgtgagctttaataatgcaatgttcagtatttcaagcagctctttttgatgtctaaatatccatctgctcttaatttaaaaaaaatcattgcatctacacaatggaaaaaagaaaacttcacaaacattttctcttttatcctgaattataacacttactcaataaaataaaaatatcaatctctcagcattcaagatttttcttaagctgacaagttttgaacatcaaattcatccatgtttatgaaatgtgttttaacaaaattctcccctaataagaattaaatgttttatgtcaactgaggaataaattcatattagaataataggatctttgagatgagggatttgtaggtgacatggtacatttgtaatatttataaatgagtaaacagcaactgataaagatgaagtcctaagtcacacagtgggtcaattttatatgctttgataaatgctagtttaatttaaaatgtacagttttcacagttaggtatccaaggttcctttctttgtagttttctcagatgttttattctgagaaactgaaacaattctgataactatcattaatttaataaaatgtaccacaattatatagacattctagataattgaatctaatttattacccatttttccttaggatcacaacaataacagaaaccatcatttcactatgtgtatacccaagtattgaaatagaggattcatgagaatcataatgactttagcacaccaattccagtctccataatggccttccaggactgcagggggccaatcagcgccttcctcctggagaaaacagtgattctaaagtttggaaaggctctcaaaagtagtaaaataggtcataaaacagagttaaatatgttttatatagcttcacagactgatgtgccgtagaatttattgaggtacttaaatggattttgggctggccccttgtgggacatctgattctgtctttatcctggaaaaagtgttaggcagcctagcaaggctgctttcctttacccaaaccaaggcacatttgagatttcacagggccatgctggtgcgaatgtctccagaagataagggtcattctagaagagagagaggctggattaagggtagaggaggcatgggaagttactgggcaaatgtccagcattggattagagactaattaaatacacatcctttattttctcatcttttttctgcctggcctctcaaaacgtagattgggaagactatatggagaatatatgtatatatatatagatatatacacacacacacacacacacacacacacacacacggaattcatatatatatgatgctttgtaaacttgtggccatctcacaacacaaaaaaacctgactgcaatattgtagttctgtaaagaactgcttaatgctagcaactgagaggctagtggagcaatgacgaaagaaaatttaattttatatcctgaataaactctagctctatcacttgacagcttcgacttttacatataatacttctgcaaaattattaagtccatatccaacttagtggagacacattttgagtttgaaataaaatttaagcaattctttttttgattgggtccatgttttcgtctggttttgccaagttgaaactctgcttcttagaaaataaatgaaagtctctatgaaaaaaagattttccttttatttgtccatttatctgtctatttatttattttacaatactgagtattataaaaccatagactcatgagataagtagaaatatagtgagtggttaagagcctcagcattggagacagagagtcttgaattcaagttccagctctgccacttacagcccttgaggccttgcaaagaactggatatgaagctggattacagaaaccaggtatgatttcactattaagaaaaatatttcaagaaaaggtatcaccaaactagaaagggtaggaaaaataagtcccccaatatagagaaaagacagcaggttactcattactgctttgcgtaagttcatgcttgaagggctaaaccaagttggtccaacccatggcctgcaggccgcgtgcggcccaggctggctttgaatatgacccaacacaaattcgtagagtttcttaaaacattatgagatttttttttgcaatttttgttttgttttgtttttaactcatcagctattattagtgttagtgtattttatgtgtggcccaagacaatttttcttccagtgtggcccagggaagccaaaagattggatgctccttgtctgaaccattgcaacatactcaaagaaaatgcaaaatttaccttttaaccatgaataataatagtcatgtaattgtgatgagggaaataactgcccaagactgcggtcagaagaataatttctatacatagaaaaaggcaaattttaggttccaaacttcagtgtgcttgtttttgacctttggaaaaaattctaaaataatgatggctattaaaaagtcaaaaaaaaaaaaaaaaaaaaaaaaacagaggctggtgaggttcagagaaaagagagcacttatacactattggtaggggtgtaaattagttcaactattgtggaaagcagtgtggcaatttcccaaagacttaaacacagaactactatttgactcagcaattccattactgggtatgtacccaaaggaatataaatcattctaccatgaagacacatgcacacaaatgttcactgcagcactattcacattagcaaaaacatggaatcaacgtaaatgtccatcaatggcagactggataaagaaaatggggtacatatacactatggaatacaatgcatccataaaaaagaatgagatcatattctttgctggaacatagatggagctggaggccattatccttggcagactaacataggaatagaaaccaaatatcacaccttcacacttataagtgggaacttaatgatgagaatacatcggggcctacttgagggtgaagggtgggaggagggacaggataagaaaaaataaatattgggtactaggcttagtacctgggtgatgaaataatctgtacaacaaatccctatgacatgagtttacttatataacaaacctgcacatgtacccctgaaacgaaaataagagttaaaatgacatcagtgtttttttaaagaatcagagaagtaagtactatgaatcagacttggtttgttaagttttagccaaacattacccctactggaggtatgaatttcaagcttagattcccttaaaactgggactttccccaccaccaggggtgatcttaatttagcatcccatcaaactgccccatggatcccacatataaggcacatagctttctcctgtaaaaaacatctggggttaccccatattgaatacaggcaccaatcagcctatccatctacccactgactaaagcacttcattctacttctctgtgaaaggtgagacatgcatgatgagtagtggcacctctactctaacagaacccaggctgagtccaaaagatgccctgacatatgactctcagccccatggtaagctgacaggagtccctgaacatattgtttttgctaaatgtacagtgttgtgttttgccttgctccagatcccttacacatcattataaaatccagaagagggcctaatggcatgactgccctgctgacttacttaagaccataggtgacatggttatctaataaaaccacatggatttcttattgcaaaaatgatctatgactcaaaagaagtcacattgagcagcaaagattcagggatatataattccaagatccacatctacatttaaatatctgcagctcctaagtagcaggcaataagttccaatggagatactgaaagctgtacgatcataaatgatgtatacattcttatgtgtatactttcttcttatgagaatgctttatcatcacagctgacctgcagtaccattaaataagattcacttaataattattaccttgattttagtcatatgtacctaggaaagtatattttcatctacagtggcatgacacatttcagaagtgtcccataattctgtatttacataaaaaatgttaaaagagatgctgtaaactcttctaatttctagggtacagataacttattcctcctaaatgaacggttttattgctgagttgtatgaaggcaatttagtagtgaccacagaactgatgattgacttctaaacttgaatcaacacacatagggaaatcatggggtaccgtctatgtaggatgagaaaagagggaaataatgggagaggaagactacttctgtgcagtcgatgttgcacttgactgaataacctacaccacaactgtttgtgattgtactgctcttgttagaaaatgtaaggtattattagtatgtagaagttgaaagagaatagaaatggctactttcaattatgttttcattatatcagactttcacccagaagataggaagtctaatgtgtgaaatattgcaagtccaggtttgaaggccagaagcaattgctttcaagtcctgcacagaagtttgcattcagcttcttcagcttgctccctaatttgcttcctctatctctccctgtaattgaaaagtgtaaaggaaacaacatacctccttagtttaatatgttaacacctgatgattaagaattgtgtgaaaaagggtacagcaaatgaatgaatgatgataaacgtttcaacttttagaaaagttcgccactcaatatatctaaaattggtttttgccaatttcagaattcagaaaggtaatctattttgttagttttagtgaaaactcaatttatcctatacaatagtaagtattgtatggtaaactcaagtccttaccagtgtagatcaagaatgtgtcttattattattgagtactatgaaggtcctttttcctgagagaaattacaagtcatcattagtggcaggtatagaaaatattattttcaaattctttaatccacttttcattttaggatcagggaagtcctacaagggagctgaaggccaatgtacatagcaaaacaaaaacaaaacaaaacaacaacaacaaatgccacagtatttcacattaatgctgggcctcttactttccaaggtttgaaaaagcttatggattctgggtctgtacttagcctaaaaatcgaacccaggataataagctttttccaaggcagtgcatgatgaataatatcagtgtattctattcattttcaatgtctgcaaacggggttaaccccctttttttcattagtgagtcaaaaggggcataaaatgggggcacattggttgaagaagaggccctggatgatggttccaatcaaataaccaatgacacaatttacaggactcccttttctcattgtcagtgagtggtggtggttaaatatgttattgggcatcaccctagctttatatcttggctttccctttactagctgtgtgctcatgaacaagttatatatcttacttgtcatgtactcatgggaaattgagtttctacatgtaaagctatttgatcttggcttggtacaaagtaagcactcaataaattttgaccattattattccggctataaaattatagaattgaactagatgagagttagtaatatctccaacaactttgagtataaaatttaggcttataattaatagattataaaacaacttaaaaataatcatttctttccttcaaccctactgcttacgaatatgtgcaacacattggtaagaacctccttttatacctttacaaagagcagaggcactatcttcagaggcctatctctggtgtccctgtgaatttataaagttaattctgaagttgtacaactagcatttcaaagaatgactcaattacagaacccaatgaactctttatatgaggatttaataattaatttgataatttaagtaatttataagtgtatttgttcacattaattaatattattaaacaaacttaatttatttaatgtaataatttaatattggaccctctctgcttcatttggcattgcttgcattcttcttatctggggcatgcttttctcatcgtttcctctatgggcttttccttgggcttctcttctgctatatttttcttaaatattgatgatcctcagggttccactcattactcacaactcataattgtgcacactatacctgggtgatcagttttttcattctgtacaactaaactcttctcatgcttctgacctgaacattcaacaaactactggacatctggagctagaaggcacactgatacttcaaactcaatgtgtccacatgttctaattttaaatttgaaaagttcacttcctcgcttgatgacatcatcatccattgaaactagacacctatgaattgctcttatgattcctctttcttcctcacatcccacatccagtcaatgaacaaatcttgccaaatttacctccaaagtactttgtagtcatttttccttctcattccattcaactgaggctttaattcacttgcttaaattcctgaaaggtccttgtggcttgttgttctgttccacttttgtctaatcaaatccattaccaaaataatatttataacaatcaaaactggcagtcttccctctctataactttttcttatgcacaacatgtcaaagtccaccctccctgaagaggcccttgatgagttctctagttcatctttctctatagtccatatggcaggttttgtcatgataaaaccaagatgccaaattttgcttcacatggcatatatttatcacccctgtgttttattaaataatgttttcactatctgaaatgtgtctctataacggttcccttctttctgtgttttttcttctaaccaatcactcaggctcaaagagaataacatcttcagcccatgttccctgaaaccctcccacctgccacgtcaggctacgccatttactgtgtggccttgaacaaattacttaaaaaatataaaaaaacactccatgactcagtttctctcatagtaaaagtagaataataataataatctcacagagtggttgtgggtattaaagagaatgcatacaaaatgcttacacagtcacttggatacagaagcccataacaattgttggtttctacctttggaatcattcttcattactactatagtaccctcaatcaataccattgcaattttcacatgatttgactgtgagtttatatctatctttactaccaattaactctttgaagaagggaagtacctgggtcatagtcagaaaattattataggttgaaccaatgtacatattcacccatttgctcatccctggaaatagaaatttatttatttatttattgagaatagaaaccttttacttcttcaaaactaaatgtctaaaagtaattttcagtcattaggagaatttatttcttcggttcctttaattaattaaagttgttgagagattctacaaatagaacattttaccactgcacactaatgatgtatgtcagaaatagtgaagctcagagaaacaaactatacttctttgcaataattatttccaaatgttacaatcccatcatctgttatgttattcccacttgagagagtttgtaagtaatttaaggtgtggtattaattattttaaacatgttatttgatttttctgagaaaaaaatttcaataaagcagaccttgatagatttagtaaaattaggactgggcatggtagctcatgcctgtattttcagccctctgtggggagccaaaggcaggaggattttttgaggccagaagttggagtctagcttgggtaaaatagcaagagtctgtctcaacaaaaaattaaaaagttagtccattctggtggcacacttgtagtcctagttactctggaggctgtgggaggatggcttgagcttagaattttgaggttacagtgagctgtgattgcatcactgcacttcagccagggccacagagtaagaccctgtctctaaaacaaacaaattaaacaaaaaaaaattagcatcagaacctatctagcacccatgtcaggggagtcttatattaaatgcaataagtattctatttatttaaattgaaaaaccctttgatcactgggaattttgaattctaagagcatgaacctactaacatttgaaaaaagataacatttcttcccttaacactgagtgtcagtagcagaatggcatgggttgggaagataaatatttattgaactatttgatccattgtcatttacagaagattcagaactttaaacaaagagtgtgtagaggaatctgtctcctgcctatctgtccctagtcaaagtggacctaaaaagatacagtaagaatgctcaactaatggacagagtaagacagatttgctaggtagataaattgatggatagatagatgcatagcagaaaaagaatcatagagaatttttttctccccaagcaatttttattcaagttaaaactgcaaatgtatgtcctgtgtccccatgtagactataagttccataaaggcaaacataggtgcttgtttttgtcactgctatttccccaaagactagaatatacaatagtaggatgtgtaacagttaaagaggaaaaacatgaaaaatgactcaacagtaaaagacaggtttattttggagaataaatctgagaggggcttctggccaatttcagtcaggagcacactctcttaaagactaagagtatttaagggtttagggagagagcatatcacagtcttgcaatgtttctgagtggaggagtttattgtggggttagaatgtctgtggtcagaggggaggtaatcttggggctgacctctccctggtcagaggggaggttatcttggggctggcatgtctctggttggggaagggtttatcttagaattggagtgtttctggtcggagatgtcatttgtggttcatggtcatgctgacattagccattaggctgatgcccttttgattggattaggcagttttttgatcaaggggaactttaaaatggtggttcttgtccaagatggcgatgctcctgctctgtcaggatgcttaattaataattaatatttgctaaagaaattaataaatcatagatgaaaataaactttctctccatttctgaaatcagaggccatactcccttagcactcatgactacaagggacctcagcttcaagccttgccttgcttatctccagagcccttcttataaattcgtgagtttatctccaaacctaatgtgggaaatctaaaaaaaaaaaaaaaatcaaaatgtatgtagtgcgagcctctaagttttaacttttaagtaaggacaaaaggtcctagagttctgttaatttggtaaccttgacaaaaatcaaagacattttaagagcttaaaaagctaggctgacccacctttagacatccggtataatcaacttccattaagatctttgttatgtgcagaccctgtcaaaaaaaaaatgagataagccttatataactgtaaaaaagcagcaattcatctgcattcattttaacttgaaacctgatggtagaagatatgaattagataatttgacagcatgtgttttggtggttcttatagcttgtgagagactttgtaatgttctttttcctcactttttcttaccaaaggtcatattcctacattctgtattactaaagataatatcaaaaactacatagtttttgcagtttatcaaaaaatagttttctgatacattttttacatagatctggtttacagattaaaaacagttcattagttaaatctgaatttcagaaaaaatgtttaactagtttcccatctttgtattttctatatctggcaaatgtgtatagatctgtataaatacaaactacaaaagcagttctggctatctcaatgtatgtttaggaatgtaaataaataatttcatttgtaatcaccacattgtcatatttttatttgtcattttatataagatatataataattttattccttctcttggaattaaaatggtagtgccatgtcaccttcatatgttgcctgactgattgccaaacatagatgaattgaggagacttatgaaaggtctcctcaaatacatactcagtacatgaacgctgacatccttgtagtaagatcaacgtgggaaaaaataaccagcctgtttttgagttaacaaatagaaacaaataccagagagatcaaagcactacaggtctgtgtgaataatcatcctcctcccctcccctaaccttgattttttctcttacaattaaatttatctaaagaaaagacatgtctgtctggttacactcagatatcactgagtagagtcagtggaaagagactgactatttccttgtccaaaaagagaatgaatataataatgctaccagcattcagaagttgctgggaggatgaagaatatcacctttttagtctgtaaacagttaagcacaaaattactgctaattaattaggtaacatcaattgtgtatttttcttgtggtttccaccaaggaattagaattagcttctgagatttaagttgtaaaattaataccccgtgaatcctagcaggaaggtgcaaagcactttgaaagagtggtggtggtccccaaacctgtgagatggcatacctgagtgtaagcagataggcatgtcttttctttagataaatttaagtgtaaacagacaataaaagtagtggggagggagagtattcacataggcatcacgcgttttgatctcgttggcatttgtttctgtgttaactcacagatatgctggttactttcttcccatgttggtcttcctacaaggatgaaaaaggttgcttatgagggtggaagcagtttcatttccatgtgtttgccttcattcatgattaacttgagtcttttgctgagatctgctgacacattgggtttcagaagttgcatggctcaggcatacttttgatacatttaccaagataatgaatgccttcataaggcccctagaaagacctttttttttgaggtggtactgataactccacgtagccaagaacgtaatcttgttcttatttgaatttctgcatacagtctgtattggaaaaattgttttaaaccatgtaaaaaaaagtgttgcttctatctggcattgaatatagcttaattaatctcattcacttctagtttttggaatatctcagttctgtcatctatcagaaattagggtaggaattgtgctaattttttaatggacatattaataatgcagataagtttatcattttgtacatctacaaataaaataaagtcctcatgaattaagttatactatataaaacttactgcacatgttttcttccaaagaaacttaatcttttgggagaaaaatatgtatatgtctcattaacatcgcttataaggttaatgtaaatttgctatactccagacttttaagccttaattggcaatacccataatgctccacaaaatgataaatattagttttttaatttttattcagtattaactgaagacacaaaatgatactcaaaatgtgtcacagaaattcttttgtctttttattatgaaactttaaaaaataccagggaaatagtatctataaatacttattacaaaagtagaatattggccaggcgcagtggctcaggtctgtaatctcagaactttgggaggccaaggcaggtgactgatgagatcaggagttcaaaactagtctagacaacatagtaaaactccgtctctactaaaaatacaaaaaaattagcgaggtgtggtggtgtgtgcctgtaatcccagctactcgggaggctgaggcaagaaaattgcatgaacttgggaggcagaggttgcagtgagctgagatcacgccattgcactccagcctgggcgacagtgcgagactccatctcaaaacaaataacaacaacaaaaaaaaacaaaataatagtagaatgttatccagaaccttgcaaccttgcagtggttttgcagtacaccaataagttttcaatacctcacatcacctttaagctctgctgccctctcatataaacaggtctagagatagttccaacataacagatcacaaagctcatctaaaacagcaaggatgttgtcaagtgctgttgtgtccggaatttttgggttcttggtctcgctgacttcaagaatgaagccgcggacccttgcagtgagtgttacagttcttaaagatgttgtagccggagtttgttccttcagatgttcagatgtgtctggagtttcttccctctggtgggttcttggtctcgctgacttcaagaatgaagccgcggacccttgcggtgagtgttacagttcttaaagatggtgtatccagactttgttccttcagatgttcagatgtgtctggagtttcttccttctggtgggttcgtggtctcgctggcttcaggagtgaagctgcagacctttgcagtgagtattacagctcataaaggcggcacagacccaaagaatgagcagcagcaaaatttattgtgaagagcaaaagaacaaagcttccacagtgtggaaggggacctgagcaggttgccactgcaggctcaggcagcctgctcttattcccttatgtgcccccccccacatcctgctgattggtccattctacagagagctgattggtccattttacagagagctgattggtctgttttgacagagtgctgattggtgcatttacaatccttgagctagacacagagtgctgactggtgcatttacaatcctctagctaggcataaaagttctccaagtccccaccagattagctagacacagagtgctcattggtgcgtttacaaacctttagctagacacagagtgctgattggtgcattcacaatcctttagctagacataaaagttctcaaagtctccacccaactcaggagcccagctggcttcacctagtggatcccgtgccagggctgcgggtggagctgcccatcagtcccacactgcactcctcagcccttgggcggtcgatgggagtgggcgccgcggagcagggggtggcacccgtcggggaggttcaggctgcatgggagcaccctggggggcggggcttgggcatggcgggctgcaggtcccgagccctgccccatgggaaggcggctgaggcccggtgagaatttgagcgtggcatgggcaggccggcagtgctgggttacctggtgcaccctctgcagatgctggcccaggtgctaagcccctcactgcccggggccggtggtacaggctggccactctgagtgcagatcccaccgagcctgcgcccacctggaactcgcacttgtgcacgagcacctcatgcagccccggttcccacccacgcctctccctccacacctccccacaagcagagggagctggctccggcctcggccaacccagagaggggctcccacagtgcagcagcaggctgacgggctcctcaagtgtggccagagtggatgccgaggccaaggaggcgccgagagcgagcaagtgctgctagcatgttgtcacctctcaatcctgcctctaaacaggacaccccaactgctgttgggaatttggccgatgaccactctagctacttccttctggataggggtgaagaaggggccctgcagttgtagtgtcctccagaggagagctctctaggccagtggaagggccagtgggtcaatcctgaggtcctcaatagaagttgttagttgggctcatttggggttccatttgtaagaccttctgtatgtagcttgatggcctcgattctagcggaaacaaatttgacaagaaggttaaaaatagagggtccaaaggcgagtaacagcaagatggctgccacgggacctagaaaggggagaagccatgttgcccaactccagaggttggtataagagtttgaaaggaggtcaggagattgagaccattctggctaacgtggtgaaaccccatctctactaaaaataccaaaaaattagccaggctaattttggtggtgggcgcctgtagtcccagctactcgggtggctgaggcaggagaatggtgtgaacccaggagtcagagcttgcagtgagtcgagatcacgccactgcactccagcgtgggcgacagagtgagactccatctcaaaaaaaaaaaaaaaaaaaaagagtttgaaaggcattgtctgacttcggaagccttttcctataaatgctgggtggcatctcatactatccgtgactggttagtgtaaaaacaacactcttcccctaagaaggtacaaagtcctcctttctcagcaggggggaggtctagacctcagcggttatggagagtcactgctgctaaggtgtctatttgggattgtagagtaaggatagatttcgttatttcttgcaaactgtctgagaaatcctttgagagtgtgtggtagtaggataatgcatgttacaccgttaacttttagcaaactttactttagttgaaaaccttgtaagtttgggattttaatttttctttgctattaataaaacctcattcagtccatattaacttagaattggtataaatgtctccttcctgattctgtaagtactttaagatttggctcagtgcaaacagctcacacgtttgagcagaccaattattggacagttttcctaaatctgcttctataagagtttccttatcacttactgaatacccattgtgtcttttttcctaatcgcccaaaaggaaccatctattgtcctgtcctgaaaggagttcctcctatgtctggtcggaacttcctatggtaattaattaagatttagatcccctgttaggaaacttcctgggttaaggacttttgataggaaggctatgggttgtcattggcctcagtgctttcgggctatgcccttgtttacactgacaacaaggtggtattgtagtgttacagggtcatggagaagaccgtcaattatcaattataggttttaaatttaccctggcttttaaaggaatagggtacactgttttttctttactatttctctctctctttctttctctttgacttctttgtctctctttccttctttctctctgactccctctttgtctcttcctctctttccttctttgactttctgtcgctctgtctcttcctctgtctccttctctttgtctctgcttcttcctctctctgtctcttcctctctctctctctctttgactttctgtctctttctctctttccttctttgactttgtctctctctttctttctactggtctttccctgcctctgccagctgcttatgctgctgttctcccctctccttcctctttttgatggcttcagcagtggaagactgccaccaccttgggtttttgcactgtgcaataactccataatttccttgtggtatttaatgggggttcccagcagttaggaaccccctttctttccatattgcagcatgggcatgtaggattagataagcatacttgctatctgtatacacatttattctttttccctttcccagttctaaggctcaggtaagtgccactagttctgctaactgggcgctggtccctggggaaaagggcttattttcaagtatggttacatcactaactatggcataacctacccttcgtatcctattctccacaaatgagcttccatcggtatataggttaaggtcaggattagctaaggggactttgaagagatcatctcagggggcataagtctggactataatttgttggcagtcaggcttgattggctccccatcgtctgggagaaaagtggcagggttgagggccacgcatatacatatttgaagcaccggtccctcaaggagtagcacctggtatctaagtaggcagttgtctgatagccataaacttcctttggcacctagtatgccattgacattatgagtagtccagacagtgagatcctttccttgtattattttgatagcctctgacactaagatggccaccgccacaactacccgtaaaacagtgaggccagccttttgctactacatcaatttccttacttaggtatgccactggttgtggggttgtcacacgagtctgagtatggactccaagagctatccctgctgtctctgtgatgtagaaagaaaagttttgtcctgtcagaaggcttaaagcaaagctgaagtttgaactagggcctgctttaaggttttgaaggctgtttctgcctctggttcccattctactagatgagtatttgctctctgggtctccttgattagagtatagaggggcctggctatctcgctgtatccggggatccatagtcggcaaaagctgttgattccaaggaacacctgcaactgttttaatgtcttagggcaaggataagccagtataggctgtattcattccttgctgagggccctggtccctctggctaagattaggcctagatatttcacctgctgcaggcaaagctgggctttcgacctacacaccttgtacccttgatcggctagaaagttcaagagttctagagtaccctgctggcatgaggcttccgaactggtagccaagagcaaatcatccacatactgaaggaccagagtgcctggacttgagaagtggcctagatcttgggccagtgcctgaccaaacaggtgagggctatccctaaacccttggggcaagactgtgcacataagttgggacgtgtggtctgtgggatcctcaaaggcaaagagaaactgggagtcagagtgcaggggaatacagaagaaggcatccttgaggtccagaacagtgaatcattctgcttcctctggtatttgagagagcagggaataggggttgggtacaactggatatagaggagttactgcctcattggtgagtctaagatcttgcactagtctccactgaccgtcggtttttgtacttctagaattggggtgttgcagggactgctgcatttccttactaagccttgagcttttaaatgtttaacaatatcctgtaaacctttatgagcttcaggccttaagggatattgcctttgataaggaaaagaggtggggtcttttagcctgatttggactgggtgggcattttttgcccttccaatgcacagacttcagggttgattccctcttcaagtaggggacaacaaatgggtaacttgtcccctatattcatgtagataatagctccacctaatatatctctacctaataagggtgtgggactttcaggcataacaagaaaggcatgtgaaaagagcaaagtctcccaattacaactgaggaggtgggagaaatacctggttacaggctgtcccaggattccttggatggtaatggaccttgaggacagtcgaccaggacaggagattaacactgagaaggccgcgccagtgtccaggaggaagtcaatttcctgaccctaagtggttaaacatagccagggctcagtgagggtgatgacatgagctggcgcttgccctgggcaccctcattcctgttgttggatcgtctggctgggggcttctgatccagagaatcttcgttctctggagcagtgcaccttccagtgattgcctcggcatagtggacatggacgatggggcagcttgtttctcattggacaatcttttttaaagtgtccttgtaaaccacactgataacaagccctactgggtgattagcctgctccattttctgtcctctctgaaccaccaaggtttctttgtctgagggccatgactaaggctgcggcctttctctgatctcgcttttccttttgggcctgttcctcttggttcctattttagaacaccgaggttgacaggtttaataatgcctccaaattttgttcagggcccagggcttgcttttggagctttctcctgatatctgcagctgattgggtaataaacttatcttttagaatcaattgacccttgagtgagttgggtgacaggggagtatattttcttaaggcctcccatagctgctcgaggaaagcagaaggactttcttcctttccctgagttatggtagacatcattgagtaattcatgggctttttcctaattctccttagtccttctagaacacaggtcaacagatgtttatgactccggtccctgtgatctgagtcgaggtcttagtggggatccatactggggatggcttgttgaccagtagagaatttattcttttcttcagctgtcattctatcatttactttactaagataccaggtatctccaaactctcaagctgcagctaaagctgcattcttttcattagaggccagggtttgatctaacagtagcatgacatctctccaagcgaggttgaaggtttgccctagaccatgtaggatatctatgtacctatcaggatcatctgaaaacttccccaggtctgccttgatctgctttaaatcagagagggagaaggggacatgtacctgggttgggccaaattcccctccccctatagcttgaagaggacataaccgatagcctggggggttagtggtcctttggagatttctttgcttatttccttctgggcaggggagattagaggaggattatcattaataggaaggggagctatagggatgctaggatatggggataagctgagaggtcctcctgtgggatgtaaattgcaagctttgcatagttgtgtattctccctcaatgaaaagaaagcttggacataaggcatttcactctatttgccttccctcttacagaaaaggtcaagctgcaggatagtgttgtaacttgtacttcccttaggtggccatttttccccatcagagagagaatattggggccaagccatagtgcagaaaaaaatgagccgcctctttctcagggtttgtgggtcaaattggtcccaatagctttggatgcatttcaagggtgagcctcttgatgcctgagtgtttcccatctgaaagacaaaaatgcccccagttttggtttgtttgtttctacccttgcccaagaacccacaacagtccctggaccctgctgatagaatagttgcactcaccaacacagcagcagaaacaacccctacccaagaacctgcaatggtccctggaccctgctgatcggaatagttgcactcactgacgcagcagcagaaacactagttttcaccttagaccacaaagagaaccaaggaaggtcagatttagtggcccttactgatgcattcttgaaaacctgcactcttgcctgtcctcctagaccacaaagaggaccaagaaaaatcgggtttagtggcccttaccaacgcattctcaaaaacctgttagagtcctaggcattcacctgttagtattgggactttacccgtgtcctataaagatgttatgccccaaaaatgaagtggagggccataccctgagggagggaagggatctccagagttggaagagtgatgccctttgtcctcacttacatgaataggaaggatacaatttctgaggctacccatatcctaccttcaggaatagcttttgttaggcctgcttgtctgaggagggatcctaaaattccaggtagtctcccctacaacagggctttgggcaaaaattgtgtccttctgattagtgagcccaggtgcctaaagaagataacagaatcctggagtttatactagaaatcattcttacaggagaaaatagaaaatcaccagagacagggagtgatttttagaagagggactagcctcagagaagagaggtgagaggaagttttgtctggcaggcattaggacccaggagtcaagggtcagggtagatagaatagatgggctagtcttgcttgggtgacatgcctttgagagttctgctcatggccgcatggtcaaccaacttgttgtcggcaccccggagctgaatggctttcctctctgtcgaccctcgactcagcccaggaaaacaggaaaagtggaagctggttccaggcaaaccaacgctcccaactccgaagagtcaggggttgttagacagccctttctcagaaagcctgacacctgtgtcttcagtctggcagccacgctagtcgcttttaactgtgcctggtatttagcccctgaattctaagaaaaaataggacagaatagcaagcaaaaggggtccgatggtactcaccgcttggcgataggtgatggtctcaccgcttggtgacaggcagttgtctcaccgcttggcgataggcaatagtctcttcgtggttgccaaaatgtatctggaattggtgtgttcttggtctcactgacttcaagaatgaagccgcagaccctcgtgataagtattacagttcttaaagatggtgtgtctggagtttgttccttcagatgttcagatgtgttgtttcttccttctgttgggttcatggtctcgctggcttcaggagtgaagctggagaccttcgtggtgagtgttacagctcataaaggcagcgcagaccaaaagggtgagcagcagcaagatttattgtgaagagcgaaagaacaaagcttccacagtgtggaaggggacccaagtgggttgccactgctggctcgggcagcctgcgtttattcccttatctggccccaaacacatcctgttgattggtccattttacggagagctgattggtccattttacagagagctagttggtctgttttatagagagctgattggtatgttttgacagagtgctgattggtgcgtttacaatccctgagctagacacagagtgctgattgatgcatttacaatcctctagctagacataaaagttctccaggtccccaccagattagctagatacagagtgctgattggtgtgtttacaaacctttagctagacacagagtgctgattggtgcgttcacaatcctttagctagacataaaagttctccaagtccccacctgactcaggagcccagctggcttcgcctagcagatcccgtgctggggccatgggcggagctgcccaccagtcccactcagtgcgcccgcagtcctcagcccttgggcagtcgatgggactgggtgccgtggagcaggggccggtgcccatcagggaggctcgggccacacgggagcccaccggttgtgggggagctcggtcatggtgggctgcaggtcccaagccctgccccacagggaggcagctgaggcctggcaagaattctagtgcggcacgggtaggctggcagtgctggggtacctggtgcaccctccgcagacgctggcccaggtgctaagcccctcactgcccagggctggctgcacaggctggccgctctgagtgcggggcctgctgagcccacacccacccagaattcacgctggcccgcgagcgctgcacgcagcaccagatccccccccccatgcctcttcctccacacctccccacaagcagagggagctggctctggcctcggccagcccagagaggggcttccacagtgcagcggcaggctgaagggctcctcaagcatggccagagtggatgctgaggccgctaagcaggcaccaagagcgagtgagggctgccagcacgttgtcacctctcactgtgactatcatacttttccagtcacctttaaccaaaagagccgcccgagttatctgctatatgatattctgatacagagttctaatattgaagttatagttcttaaataagtccttgttgcgtgtgaaagcaacacttggcagttccagagcctgagtagaatcctcaggaatagaccctgatgcttgaaagcagggaagccgattcaaggaaaaaggaccttgcttcagcctctatttccatgttcaggaaatgaaatataataacattaccagcatcagaaaggttgctgggaaggtgaaaagatattacttgtttaatctggaaacagttaagcacaaaattaatgttaattaattcgataacactaattgtgtatttatcttaaaaatacaggaaactaaacacgtgattattgaaataccagtgatttgatggaattcgaattaaccatactttgagataaattagaaagatgtttggttttgttgttttttaaaaaaaattgatatatattcagatgaataaagattattataatttatagttactactctagaagtttttttatcctagaactttaatgctgagtaatatcataaattattaataatatacaatgtgaagaaatatagtgtatataccttgatttataacatgtatccattataagccaaaatttttgagaaatatatttttgagagactgtacattaaaaactggatgagattgattatattttatttttatgaaaatgattatagaagttaattttattaagtgttttatgttcaagattttatgtaaatcctttcaatattcaacaccagaaggaataagtctaagatatatattattctggtagaatttagtcttttagtttattttcattttcatttatttttataacaaaaaacattttactaaaacataagacttacagaagtttccagacaagccatacaaaatggtcacaagctttttctgaaggggagaatctatacttgacagcaaagtcacagtgttattattgagagctgtgatgtttgtttaatgttcccattctggttcaaacaatcaagcttgtccatctacagcatctaaataaagttagacttggctagggaacatattctaaagaacaggttaggccgggcgcggtggctcacgcctgtaatcccagcactttgggaggccgaggcgggtggatcatgaggtcaggagatcgagaccatcctggctaacaaggtgaaaccccgtctctactaacaatacaaaaaattagccgggcacggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaacgggttagctgcttttaatcaatgcaattagatcaccaaaaaaaggtgggaaaggagctcataaattaaaataaaactacctcccccctgaaaaaaataaaataaaataaaataaaataaaataaataaaaacacccacgcccctggagctaacctgacaactaccttcattcacagtgctttacacttaaaccaggcttggggaaatgaataaaagcagagaggggccactgcttttaaacgtttcccaacagtccagacgatacttctagcctctgctcatactttttgacagtgaatcagaacaaaacatagatttgctaatgtgcatttaatcaccaaaggactgaagaagtctgggcttttattctgtagtgtttctaagaccttgtccattaaatgtaaaccaaaagaaagaagtcttggcagaacaggagaagtgatgcatacttgatgatcggatcaatttaaatattattcatggcatatagcctagtccctgctctagctgtttatatggcttgggcttcgttggtgtttccactgctcctctgcatcatttgctaatggatcatctggatttggagcacttaacaaggcctggatccgtagcagaactgtgcggatctgcagggctggggaccacttacctttcaaaatatcttaacgtattctccccaacttgtctacattaggatgacaaattttggtcataaaacgcactttaggggctgccattgggtattcttctggaagaaatagtccaagtttaaaagtccctccctcacagtgggaatcccagggactggcaatgaccacatgaaaataatggatgttgctctcatatggttctgctttgaggccaggaactggttctgccagcaaaagctgggtttccttgacgatcctgctgggcagcccagccatcttgtcaggtcctgagttgggtctctggtctctaacttctagtttatatatccttgttttcaatgtacaaagatgtacactttagtagggaaagaaagaacgattgtcactgtttaatatgcatcaattaacataagtaatctattttaatggtatttcagaaccacaaagaagaactctttccttaaagctttaaaaatgtaattgaaatctgaaaacatattccatataatttaccacgaaagagaagagacactctactacagtcatattcaattgttttgttttgtttattacaatagacatttagaacatcttatccttaaagtaatttcagttgttttgctgattttcagcttgtcagattgtttattccttttcctttttgcaatagaatgataatgagaataaattttgtactgtgtgaaaataaatttatttttataacagttaaattaaagagataatctgataaatctgaatgttattttaacagtttgtgctcctgtcatactttgaactgtaaattttattcagctgccctctatcaggcaagctttatgaattcctgcaatttgctgaaggcattgtaacaaaacaatagagtgaggtggaataaacctttaaaaattcctgtgaagattatacttactttttattatttgttattttctgtcagaattttggacaaagaagttaagacctatgctttggatgaaacaaatgattatttcctttaaagctatttcctttttactttttgtaatgaaaggcttattggtatataattcacctagcatgaaattgaccatattaaagtgtacaattcagtggtttttagaatattgatggaattgtgcaaccatcatcactatccaatcttataatagtttcatcacccccaaaaggaaccccacacccaagagcagtcactcccattcctccctactcccagttttctggtaaccagtaatctaccttctttctcttcagatttgcctgttctggagattttatataaatagaataattaaatatgtagtcatctgtggcttgcttttttcctttattatattattctgaggcttgttcattttgtagcatgtatcaatatttaattcctttttatgagctataacaataatgaaatattatatggatatatcacatctgtgtttattgattcatcagttgatggacatttagattgtttccactttttgactattatcaataatgcaaatatgaacattgatgtgtcagtgattataaagacagatatgtttattccacttgagtgtatacttaggagtcaaattgctgcagtgtatggtatgaagaaaatcattttatttatgatagcacaaaaaacaatgtgtaatattttgaggacctgccaaacaactttgcaaaatggctgcttcattttaaaaccagaaatttatgagaattttcatttttttccatgtcttcatctacactggatattttgtttgtttgagatggagtttcgctcttgttgcccaggctggagtgcaatggcacgatcttggctcactgcaacttccacctcctgggttcaagcaattctcctgcctcaggctcccaagtagctgggactacaggccaatcaccatgcctggctaatttttggagttttagtagagacaggggtttcaccattttggcaaggctggtctggagctcctaacttcaggtgatccacctgccttggcctcccaaagtgctgggattacaagagtgagccaccacgcccagccaatattgtctttttttttttttaagtttggttattctattaggtgtgaggtagtatttcattgaggttttgatttatatttacctaatgaataatgatgttgagcatcgttttatgtacttgtcagtcttttgtctttcttgggagaaatatgtactccagccttttgcctattttttaatttcttctttcattgttgagttgtaataaatcttaatatattctgagtgcaagtaatgtatcaaatatataatttgtaagcatattcttctattgtgtgcattgtttcttcatttctttatgtgtcctttgatacactaattttaaaattttgataaagttcaatttcctagatgtttttgtctcatacttttggtgttatgtctaaaaaaccattgcttaacaaaacgtcatgcaaagtttcccgtatgttctctcttctaaaagttttgtaattttggcttttacacttagatttaaatccaatttaggttcatttttgcctattgtgtgaaatagggggtccaaataaattctttgcctgaagaactttgaaaagactattcttttcaacccataattgggttgaaaaggcaattgtgaagactattttcacacaatttttaaaggactgttttttccccattaaatatttttggaattcaaatctaaaatcaaacgatcataaatgtaagctatatttctggatgctcaattctatttatttgtctgttcttatgtagtacacactgtattattatagttctgtaataaatctcattatcaggaagtattaatcttccaactttgatattctttttaagtgttactttgactattctggagccattacattctcatgtatattttaggatcagcttgtcaatttttttagaaaaaggtaattgatttttttggtagacattgcattgaatccgtgtaccaaattggagagtattgccatcttaacaatattgtcttccagttcttttcattttttttagattttctgtaacttttttcaacaaaatttgtagtcttcaatgtacaattattgaacttttgttacacttatttataagtgattgttttttgtgctattataaataaaattgttttcttcatttcatttttagacttttcattactaatgtatagacatccaattgattttggatattgactttgaattctgcaatcttgctggaattattagttctaatttttgtgtgaaattctcaggattctctatatacaagagcatgccatctgtgagtcgtcacgattttgcctctttccaatctgaatacttacttcctttgcttgcataattgtcctggttagaatctacaggacaatgttgaataaaaaggtgagagcagacatccttatcctgtttctgatctaagattgaaagcatgtagtctttcctgcttaagtgtgatattagctgtggataatcaagtttaggaagttcccttctatttggtagatgcttttcatcgggttcaggagttcccttctattcttatttttcttgaaagctcttatcatgtaaggatgatggatttgtcaaatacttttctacttctatgaaaatgcttatgtgatttttgtcctttattaatatgatgtgttatcctgattgatttttggatgttatatcaaccttgcattcctagtgtagtaaccactagttaatggagtataattcatttaatatgggtctgcatttggtttgttagtattttgttgaggatttttatttgtgtatttattagagatgttaatgtatagttttcttttcttgtgatagttgtctggttttggtatcaaggtaatacacagaataagttgaaagtgttccttcctcttctactttttgcaagaatttgttaaaaactggtattaattaaatgtttgatagagttcatcagtgaagcaggtgaagtgaagtagggcccaaacttttctttgtgggtagttttcctaattactgtttcaatctctttacttgttatagatctttccagattttttatttatccttgagtcagctttggtagtttgtgttgtatctaaaaatttgtccttttaatctaggttatctaatttgtgggaccacagtagttcatagtattccctcttaatttttttttaaatttctctaaggccaataacaatgttgctttcttcattcctgatttgtaatttacattttctctcacttcatcttgttttgtctagctaaaagtctggcaattttgttaaagttttggttttgttagttttctttattgtttttttttctactgtctattcattaatttctacccttaatactattattaccttctttctcattgctttgtgttgtttgcatttttacttttcctaatttctttagatggaaggttaggttattgatttgaaattcttcttgctttatactggcgtttacagacataaatttccctttaaagaatgctttagctgcatcccaaaaggtttgtttgttcgttttattagagacagggccttattatgtttcccagcctaaccctgaactcctgggctcaattgttccttctgtttcagcctctgagtaactgaaattatagacatgggccactgtgactggctaaggtttgttgtgttgggtttttactttcattcatttcaattatgttatgttgtaattttgtgtgtgtgtgtgtgtgtgtgtgttttgtttcgtttttgttgttgttttgtttttttgtttttttttttttacccattggttatttagaagtgtgttctttaattttcatacgtttcaattttctaattattcttctgttattgatttttgtttttaattttgtttcaagaagagatgatgaacaatttaataccttttaaatttatcgaggtatgttttatagactagcatatggtttatcaaggaactcatgagtacctgacaaaaatgtcttaatatattctgctatgattgcgtattctatagattatggttatacgtggtttctagtgctgtttaagtcttctgttttcttcatgatctcctgcctagttgttctattcattgttgaaagtgcaacattgaaatcttcaatatttatcactgaattatcaattagtctttcagttttcttagtttttgctgtgtgtactttgagactttttcctgtggttcacatgtatttatacttgttatgtattgctgaataattgacccttttttcattataaaatatatatatgttttgcttttatatcaatttttgttttacaatctattttttaaaatattgataacagctcttagttactgtttgtatagtatatctcatttttgtctttttactgtcaacctattatgtctttgaatcttgtggacaaaatatcattggatcatttttataaaatccattcttccaatgtcttccttttcattggagttttacttaattacttaattgacttttaatgtaattactggtaagatagaatttgtacattatttatttttaccatgtcttttgcttctttgttcttctattcttccattactgttttttcttcggttacatatacatattttcaagtgtactatttattacatttattgtttatacacacacacacatatatatatttttctaaagattatagtagaaattacaattaacttaaagcaatctagttcacgttaatgtcaactaaagtcaatattatacaaaaatttgctataaaagagctttgttctatgtactcctgctttatgctattatttaatcccaaattgtatctttattcattataagctgaaaaacacagttttatagttatagctttattcaatgccttttaaatcagataggagaagaaaaaatttacaaaaatacattaataataatttttatatttacctattgccttagtcaattcaggctgctataacaaaaatacatacactgagtggcctaaagagcacacatatttttttgcacagctctggagtctggaaagtccaagatcaaagtactggcagatctggtgtctggtaaggacactttccctggttttaagatgaccatcttctcattgtaccctcacatggtagagggcagagagagaggaagcaagctctctcttgtctcttcatgagagtattgttataatcattctgcagagagacagaactaataagagagggaaagtgagagcgagaaagagagagagaggtgagaagggatttattagggcaattctctcactcaattatgtagattgagaagttccatgataagctgcaagctggagaaccagagaagtaagcatcatggctcagcctaagtctgaaagcctcagaaccagggaagccaatggagtaactcaactgctggttcaagtttcagagtccaaaggctggagaatctggagttctgacatccacagacaggagaagggtgtcccattttcagaagagggagaaaaatttaccctctgctttttggttccaagcttgcccccagccaattggatagtttctacccacattgaaggcagatctttgccactcaacctaccaactcaaaggccaatctactccagaaataccctcataggtacacctggagaagcccaaccattccaatcaaatgccaaaccatctgagtttccttttcagcagaggagagacaggctcaatgcctattgaagcattaagaataattaatattttaccagctatctgtgtatacttcaatccagtcaaggtgacagccaaaattaatgatcacaggtactaataccatcctgagggccccaccctcataattttattacctcccaaagggcccacctccaaataaccttctatgggagtatggtttcaacatagaaatttggagcagagtgtacacaaacatgtaattcatagcacctatgtagtaatctttaataatagtcccttttatttcttcctgtgaagtaatgtttttatctattgtcttttcatttcagcctaaggtttctttctttggtattttctgtagtacagatatgacagaaatgaaatcactaagtttttgtttatctgagaatgttttattttctctttcctttttgaaaaattgattttctgaatataaactttttggttgacttcttacactttgaatatgctgctacctcctgaactctgtccttttggattagaagtcaactgttaatcttattgaagataccttatacccaatgagtcatttttctcttgctgctttctatcttctctttttgtctttgcctttgacagtttgtatatgatgtgtctaaatgtggctttttgagtttttcttacttataattcactgagtttcttgtatatgtagattgatttttaatcaaatttgggatatattggtaattatttcttcaaatcctctctaagcagtccatgatcttgtcccctgtctcttcaccttcttctgccaagtctacatttccttcagtttttataaactaaaatgttcttcctattactgaacattgttttaactatcctgcctctgtttttttgctcatgctgtatcctccttctgagacattttcaaacaacttatatttgttcttcaaacttcatctttaccataaatattactttcctctcaaatacatttccactccacaatctaatacaaatgtacctcttttaaagcagtcatacctttcatcacaaagtatagttactcacttgcatgttggatacgatcaaaataggcaccattttgatgtgctctgttttttacttctcctaacaaatccaagtgttactttgttatcaccatttttaacagatacatcctattttaacatcccaatatagtacttagccccagttttgcttattccagagctcatgagctcagccacttggctctaagacttgtgagtacagtaggagagtttaatgtagatggagcatctgtctgctgttgttgctattttttcgttttagaaataccatacattggtcaatttaaaatcatagaacgcaatgctctagtgctttgaatatttgaatcaattctagttgacacttcaaagttgctaatcttcattttggtggttcttttagtgtaagataaagtttacatatatgccacagaaagtatttttgtggaagaataaagacatttattaggaaagttatttagaaaattagagtaaccttggtaaggtatttacttcaacatccaagagacattacatattcaaaaggaggttttttcaaatgaaacctagattatttcactgagatttggcattagcattttatctgcttcaactaaattgtaatttgctatattagtgtatccactccccataagagtaatttctggaattcatattcatctgttaaaaaagatgcccttgtcctagtactaaaaccataatattgatgagaaaaaaatttgaggaaataacttgcctcctatgtaggatatctaattttatgcacactgtatttagtgttagcaacctgcttcgggggtagcgggtaccatacttacatgacatcctcccaaaaaatgaaatcatgatctatattattagccatttaaaaataagcaaccagaaaagctgtgctatatctatatctatatctatatttttggtgaactttattttcttggtttttccaattcctaatatttctaatagcttaaagttagttttttaaaatcatcctccgaatttaaaattcagaaatgtatgctatatgattatattagacaagacgtaatttcaggaactatgacctacattttagtttgtgttcacatgaaattctttaggattgtatggaataagacatctctacctacttcatattttaatacatatttaaatgtttttctgacacatttagtaataattaatttattaaatgtttcccaactaggataaaatttattaactatgtctaattcaaaatgttttaaaaataacagcagaaaaaaagagaaaaagaaagatataattaaagtaagactagaaatcattgatgtaggaaaaaaaagtactcagtggtgcattttaacaaatcagtaattttgttctttccaaagattaatgaatggtcaaatgcttccaagatttattgcagaaattatgggaatgcatatttattaaaaggttagaaattaagtcgtgaatgtaaataaaagttaagttgaaaattgtaataagttctgtttatgtagtaattgaaataaaatgagtagatgtatataacacataagttaagctaaaatccaagctcagtgtattggctgcatctgaagaaggtaggaggtaaataaaatcatagagaactacatggcttcagtcttcagcttcattttaagttttatttcttaatcaataaaagaaagtatgtagaacaaatatgacttaagtaacaatatttgacaaacccagatggtggatacatagctttttatatgcttaatattttcttactgtaatatatcgaattagttgagtaaagggctgctggaggacaataaaactaaggtattactaaaaaagaagcttcctttagttcatgattttaaaaaataacagttgctagtttttctttaaaaatgatacctttatgttcccatttgaccatttgaatttaatttagcgacagatccacactgtataacagattgcttggaagtgatgaatgatatactttctcacatttgtattgtagttgaatgcaaaaaaactcaatggaacaatttctgctatttaaatttttttcttattatttaaatttcctttagcaaaataaaggtcattacttttttaacccaaagaaaataacataaaatattttaggggcctattgtttaatattttaaaaattgacttatttttcaaacgttgtaatctaatagctatgtttgcaattgatgcttttaacatactcttgggttaccatggattgtttatgaaatagagccactatggactgtttaaactttaattaacagaacaaaaaccatgttacagtaatgctcccttactcatgcttgtgttctctgcactttcagttacccacagtcattggcagtctgaaaatattaaatggaaaatttcagaaataaacaattgataagttttaaattatgtaccactctgagtagcatgataaaatctcacacctacttgctcagtcctgcccaggatgtgaatcatccctttgtccagcatgtctacgcagcatgtgctacttgcccaatagccacttagtagtcatctcagttatcagatagaaaagcatagtttatacaaaattcagtgttacctatggttttggatatcaactggaggtcttgatacatatccctcatggataaggggggactactgtatttccagaaaataataaatataactaagtatgacgtaaaatgcgatattttgttcaaatgagaggcaaaaagcaaaaaagctttaattaatagtgttatatttaaacacagataagataaaatgcaaaaagactttacattgaggctcctaggagctttgattacaaacaggacatgtaaatcagaaatcttggcattcctaaacaagtcatacagtgagttaaggcactcttatgaaaaaaaatagagaagaacagtggttaattgtattaaatcaagtcaatgttatttacactttaaatgagttacattacttcagtgtttaaaaactaatttatagactaggtaaatgagaaccatcatactcaaatttcaataagctcaatatcattgtggatgtgggcaactgtcttggtccatgtgtgctgctataacaaaataccacagactgaataatttataaggaatagaaatttatttctcacagttctgctctctggtgagggtctggtctctgctttcaagacagttccttgaagagtgtctttgtgaggagaggaacgctgtgtcctcaccttgcagaaagaagaagagcaagagggatgaacactgtgaggagccacttctattcttttactttttatttttaatagagatggggtcttgctctgttgcccagagctgaaagtccgtgtcatgatcataactcactgcagccttgaactcttgggctcaagcaatcctctcacctcagcctctggaggagctgaaattacaggtgtgagccaccgtgcctggctcagaagcctccttcataagggctttaatttcattcacaagtggaagaggctttatgacttgattacctcttaaaggcaggcccctgttattaccatcaaattggccattacatttcaacatctgaattttggagggacacattctaaccatagcagcaactaagaagcttctggtgacattgggtgacattgggagtgtttgtaagatgacaaacataatttctaaacaactgatctcttactactgtttatttgtgaactttgttttgccaaacacatagaaaggattttgtactgactaatcaggcctattactagacagagggatatgtaatggtttcaagaatttcactctacaaagccttaaaggaactaaaataagttccttttccagctgatttccaatatcgattgaaaggacacactaatgagaaaaataaactaagataatgctaatcaactttttaactcaaaaaattttaaacagttttttttttctttgagatggagtcttgctctgtagcccaggctggaatgcagtggcacgatctcggctcactgcaacctctgcctcctgggttcaagcgattctcctgcctcagcctccggagtagctgggattacaggtgtacgccaccacacccccctaattttcatatttttagtagaggcagggtgtcaccatattggtcaggctggtctcaaactccagagctcaggtgatctgcccgccttgacctcccaaaatgctggaatcacagacatgagccaccatacctggcctaaatagttattttaattaaaaattgttctttacacataccagaatttttagaaacattctcgttacactataaagaccaatcaagctttgagaaaatataaaatgttagatcttcaatttctctttgacaagtaaaaacttctctcagaagcatttaaagtatttcttattcatttttttttttttttaatatagagcagtctcgctctgtggcctcaagggatcctccttcctcggtctcccaaagtactgggattgtaggcataagccaccattcctgggcaatttacagtatttaaaggaagagttgctctggctgaaagtttttcttggagagaaaaacatacctgcttaatgaacaaatctgtgtaaaacatctgtgtttcttgctcttgcagatacaaaataatatactaaaaattgtcctggctctggtgccaggttttgtggatttgaatctctactgcttagcttatcgggtttttgacctttgagaagggaagcaagttctctccacctttgttttcccatacatgaaatgaggataactatttatcaggggtccacaactcccaggctgcggacttgtaccagtccccgccctgttaagaaacctggacacacagcagaacgtgagtggcgggccagcaagcattactgcctgagctccacctcctgttagatcagcggtggcattagattctcactggagcacaagccctattgtgaactgtgcatgccggcgatctaggttgagccgtccttatgagaatctaactaatgcctgatgatctgaggtggaacagtttcatccccaaaccatcccccttcccgggtggaaaaattgtcttccatgaaactgagccctggtgccaaaaagggagccgctgctatatatgaacacagcagaggtgactattataactttgtgatagaacatgtgagtgtctatcccttaggagaaaacacttgagaaaaaatgagaataaggtataagcacttctaggaactgggcaacatcacccctccacatatctgtcccaggattgtcacaaagtgcctcctctgcttctttttcatgtagctctcaagcttctctgcagctctagcataactaccctcaggccaaatttgccattaaacaaaacgaagagacaacagagagactccaaccactctgagtagcaggttattaagtttcattttcaggaaacatcacaggtgttcattaatgacacattaaatgatgaagcttaacgtctcttttaaaaatctcatcttttgcttaattgaacatttctaatatgtaaaatctttacatagcatacgaaaatattttgagagtacaaatgacatatatttttgtcttcgagatttccctgtggcagccccaccagtgatcctgttgtgttcaattaaatgtggtaatgagtatctgactactgggctttatgtaactacttttattacgtgctttatttttacttctgtaatgtcttaataattcaaactatattttaatgctaatttattcaggtttctgctgagaattcaaaaaatggtgtcgattttattttatatttatgttcaatttttgccagaattttaattcagtcactcacattgtaggtttaaataaattgataaatggaatatatattattcccactgtttattataactaaagaaaccatacataaaagtttaataaaaagttgttttaaattaaagagatgtagatggttgattgttcatggctaatattattttaaaaactggtacacaggtaatctggcttttataagcctataaaacttctaaattttgttgagtttctttacaccacaactttataattactaattataattactttatacttgctaatttaaactaattactatataataattagctaacattaaactttctgttgctgtatttgtctctttattgaaaagcattttcaaacatataacaaaagtgaattataaccataaaaattgttatttgtattcacatattataatgtgagagccatggagtttctttgatgtaacacatgtgttcccaacttcaacaaaaaagccatatatacagaaattagcagtagtcttgcaatttattttcttcttcttcttttttttttttttttttttgagatggagttttgctcttgtcacccaggctggagtgcagtggtgcaattttaggtcactgcaacctccgcctgccaggttcaagggattctcctgcttcagcctcctgagtagctggggccacaggcacacaccaccacgcccagctaatttttgtatttttagtagagatggggtttcacaacgttggccaggctggtctcgaactcctgacctcaggtgatccacctgccttgacctcccaaagtgctgggattacaggcatgagccaccacgcccggcccttcttttatcacttggaaaagaagaaagttgaggcagttacattttcttctagcatgctgacacccctcctgacaagcagatatttactaacagagaacccttgtttatgaaataattttagcatgatgtatttggtctgttttggctgcttttatactacctgccacacagaaattgcagcaattactatcatttatattaagtttactcatcagctgtgtttcagatatcttctgttacttcatcagaaggtgctaggatgaacagcagtttctttctctatatgtttttagtctgtgttatcaggattattgatactacaaagcacctgacaagaaaatctcccccaaattataaattgacaggctttcgctagctttagaagcattctatatttatgaatcgattgttaattaacttatgtccaaagaggccatcactaccattccttagtcaagagttacacccatgagtctatatgtttctgtaatgtaaagtttcatacaatagtcatattgcataaacatgccttgtagcttaaaaaaaatcattacttttgtatttatggacatttacaaataatgtgtgcaaagactgaaaaaatataattttgttttatttattagagtcaaacagaaaagttgtaaatctctgctttttgtatgttttcattttttattttaatcagaattctttggacaaccattaatataatatttttattgttgttaccttgtgacctttagactatcttattattgtcaacatacaatatttttctcttgaatatattagagttaatggcacaggagtatataacacgtttagatgtttttcctaaaataaaatatattctgagatatcagacctttgacgaaaggattgaccatgtatattgtgttatctatagaagtctgacttaatgtagttcaataaagaaaaagaataatccctgaactccagtttcccaagataattattgatacaagagatgaaatattacaaatttaaaggagagtaaatagcaaagtttttaatatgggcaaaaattagtttcaaaaatttaaacatgaatgtaattttagtggaaatcaaccggcaacattaattaattaatgtataattaacatacaacctgatacagcctccctgaggagaaaaatgagtccctaaacctatggaattcactgcttcattctctgacttcacgcgtagttaaatcaatggaagaggctaaatcaacgtgtacagaagcagcaagtgcttaaatcatcctagtgcccctgccaccattctattataaaagtcatggaaacactccagcatacccacattttgtcaacttcagaaaagactcctgccctgataaccaaaaactgtgtatctcaaatatgtacatttttccttataataactataaaacactgtcatcagtttcttctttctccttgacctgagcccttcctcgggcagtttgagtttaaaagtgtctgccctgagtgttactcttcatgttgccaggaaacttgccttcttccgatctaaagcgtgcgtaactgcaattactattttctttttttttcttttttttttttttaagtctaagcctttatattctacgtgttttgatttaccatagtcctcactgcagcaaggacatttaaagtgagatctactatttatttttgagttcataacatttttcatggcaagaaaaaatctcagcaacccatagctgtagcttccaatagtgtttatggaagtgcaagccaagtgaggggtttctgaaaataagagatgttttccattcagtgcccaaactcagtgatatttttctccttacttaagaccagttctcaataaaaccactcacctgtacagttatgtttgtgacatctttgactacaaccatagctcagtttcaacaaacttgcagtcctaacttctaggatatgtgaggtttattgatggagatatattgtcagggcttgtgttaaaaaaatagaaactattcagataattgcatggatgccactttattgttatataattatcagtgtgttgcaattaaaagacaattttaattttgcacattttattgaatgcaatagttaaataagtcatccagtacattttgtttgcttactttcaggactaatagcaaaacatccatcattagaaatgttctttataaatttaaaaataatatataatctgtccttgaaatttatattgttaatgcagattttttctaccattatatctatcttacaatgactaacaaaactagaaaattttggtaagcatcaagatgtaaattcgagatggaactaatatctgatgggaggctacctaggtatatatatatgtgtttgttcatgtgagagatagtctatatgcttgtgcgtgaatcttagaaattatagtatttaataggtctgtgatagatgtaaactgttttaggagtcttcatattacatatgactctatttggggtattaatgctaattctttcatattagagttcacattagatgctaatagaaatccattgatctccttgacacccatgaaatgattaagataataaaagcattactggaatttgagggcaagatttagaagtaatattttgcctaacagttgtaatgttagcgtgcataatcattgaaacactgggagccacatgctaatttcttacacgttcaaggaccttttgagttgagtagtcatatccatataacaaatcactcaccttatgtgagctgtacatttattgttgtaataaaaaatggatttaactctcctagaaataagtatctcatttatttatttatttatttatttatttatttatttatttaaaatggagtctcgctctgtcgccaggctggagtgcagtggtgcggtctctgctcaccgcaacctttgcctcccagattcaagcaattctcctgcctcagcctcccaagtagctgagatgacaggcatgtgttaccacgcccagctaatttttgtattttttagtagagacagggtttcaccatgttggccaggatggtctcgatctcttgaccttgtgatcctcccaccttggcctccaaaagtgccaggattacaggcatcagcaactgtgcctggccactatcttttatttttatcttttctaaatataattgttgccagtatagtacaagctaaaagtctttctttttttttacttttggattcttctgtccttctttggattctttattattcttaactctttccactgtcttccctaactgcatgccaaccatcaggcaattgtcttttctgttttatttctaaagcagaatatattttgtaaaatttcttcatcaccatactgttagtatgatgacaaactaatttcacattaacaaaattctagctgtcaacattacatattttatggagagaaatttaggaaaacaattacatattcttaaattatgataatggaacaggaacaaaaggagttaatgtttattaaaaatgattagtcagtgctgacttaagaagtgatcttgatggaccaatgttaaaatgagctgtcaaaataagaagatatgagggctactgatctttcattaataaaatgaacatatattaaatggcatttatgaaaacaatggctgataatgaagtgagtgctatcctttttcatatctcattcagggcatccttgtccaataagaggggaggaagagcagtgctattagatttaatccgttagagaccggcactctccttttcaaaataagactagctttgcaatcgtttattgcttgagttatgtgttgagatgaaagaaagaaactgacagtactaagttaaagagtatgtattctttattgcagtaagataacctgtgaaatgatttcttgataatggtaaactacctgaacatccagcaagaaggtattggttcaataaactataatatatcaactctacaaatatattcaattcctaaaaataattttgtagaagtatattcagtgacatagaaatcgaattatgttaatttgtatttatgggcttggtttgataagtattttttggaggttctttcaatactgccctgcccttgccaatgtttgggtttttttttcttatggacaagccgactgaaaacatagactctggacactgaaaaggttatggtgcccacctccacagagactcaaatcaaacagcactgaaattaacacaaaaaaaatcaaccttttagttgtgtcttgatgatagcttctatattttatttaaacattaatataaatatgttaaaatatgtattttgttactactactttttacctggtcagaacatatagttaatcagcctactggataatagaacatgtgaagcagatactgtttcccatatggagttaatgtgaaatagttatatcatcatacattaaataaagcaattgattttagcaataaaataactctgcatgtatagatttacatatacatatataaccacaaatacgtattataaaaagttaacagtgtttaactctagtcaaaatattgcataaatttttatttttggctagcctatattttctaaaatgtctatattaatatttatatttttattaagaaaataactatatgcagagtaaacagaacactgcatgatatatacttttagtacaaattgtctttattaatatttctgaattatcaagaattttttcttctctgaatttcaaaaaaattcagtagtagccactgagtagtatagattcatgtgaacaactcaaagattcaagaaatcattttcaggcccccatactacattctaacaatttaatttaaataaatttattggttaaagtattgttagataaatattatttcttatctattcctacttcacatggcaggagtcctagatatgtgttgcttcaatctccgtatgattttgttatcctgctttacgtactgtgcagaaaaataaaactttttatggaaattgatgagtttttctcattcaccagcaaaatagaatgtaaccaaaaaatcaaagcatgatgtttaaatgaagacttattttattctttttaaatttttttgccctaaatttactatttgttaagatagttttatttaacttcaaacaagaaggttttctttttatcttcatataggtacttaaaaagtttgcttctctcatctactcctacgccatttgttctcagacatacaagcataaaccagttccagctggtttagccatttatttttcctcaaatttataacagccaaaacacccttacaccagatttttccaagtgttagatttgtgcccttttaaaattttagaaaaatctcagttgtgctaattggaactctcagtcctcaattatcacctacttgctttctttgtgtcctttttgtctaacaaatacatgctttggtgcttttgagattattaataggattagtaagtgctagataaagctcaaagatcaacagaagtttctctggcacttacctattacctacattacaatactactattaacctctaaggaaaatgaattctaatacattttaattttgcaaaatttatttggtaccatatttttgtcagtatagacaaggatctaacagaaaaccatcaaaactgtattgataatgaatgccaagcattatataatgacaagtaagggacaagaaatacttgtggtctcacagatgagcaaacccaacaactgtgacgtatgttaaaaatgcatgttaaactgtaaaagccacgggagactctagacagagtttaggagttgaaagactttacacgaacttgtgatcccttcttgaaggtgccatcatgtttagaaggtgatgcgtgtggcaggtcctagatagaggagcaggagaagtgaagtcatggagatgggaggagagcaagactcaaagaaagggcaggagtaagttgatgttaggatgatggcacagaaggttagagaggaaagccgacgatgtaagagcccagcatgagggattctgacgagttttatttccagacgagcctccacgtgaagtcagactttaaagagcatgtttactaaacatgaccactctatcgacatccttgactgtatgttcctgtttactgagtaatacatgttgcataggagaatgattatttttgtgaaatgaaacctaggtccaaaacatttcactacaaatgataaatgagacaatcggagactaaatcatctagcacagagaagatagaaaaaaagcaaatccaattcatccttttgttttgttagtgacatattgaaaggtgactgtgctcgggtaattctcttctccttttgcaaagtttcattattccttgttaactttaatgtcctttcatttgtgttgtttctattacatgaacaataaatcatatatgaaacatacacacacatgcacacacatacacatacccaattggtttagaaaatgtacaaaaatcacaaagagctttatccttctcttcttacagtcttggcttctataaagttttgctgcttaaaattcacaattagtgaattgtattgttattaatatcattttttaaaactaattttcattccagcaaaggagaaaataaagctaaattcaatactctacacgacatctaaaatctagttttcaaggtgttagatttgttatggtcatttctatataggttaaatctcatcttattttaaccttctaaaggatttatgtctcaccataaaaaatttcccagtcactgcaaatatttttaaattaggaaaatatagttcatttctcatttatagtttctctctttttaaaaaataactttgaagtcagtgttaactttcattttcttcctataaatttatgaccttatttaagtatacacatactatttaacatactttatcagagaaactgtgcttctagaaagttgtatcatcacatttgtggctaaattaaattatactgtagatatgaaatgtatactttagaagcaaacccaccgaaattacaataataacagacacctcaagtttttatgtatttgtcgtggtaaaatccagtgaagaatattcttaagctgtttaccactagcattgtgccttccctggcttctggaggaggaagagagagagagagagggggagagagggagagagggggaaagggggaggggggagagagagagagagagagagagagagatctttattaacagacacagaactctcctcctgaaagaaagaatttccagaaatcaacatctgcattcaccatacttcttacttagtttaataaaaatactttctaatgatacttctacttcacatgaaatatcttcaataaatgctactatttcatttcaggccttaggtctccaggaagggtcaattttttataactctcatttgggagctttaggctttgttctatgctgtgtgcctggcttagtgcaatgaacttaacactgtgatgttgtccctgtgattactaaaatgatttttttccttatgttcttgaaattgaatctatgttcaactggtaggctcagcattctctacagaatgatgtataaacctgtcattttaaaagataacatgaagaaatctctcaatgaggtcaatggcactgctacctttcagtaacaaaatttctactattgaaatacacttaaagcgtaattttaaatccaaagcagttaactgccattactggaacggtgaaggatacaattttaaagagaaaagattacgtttttctaaatgttccttaaattcttcaataaaacactgctattgcattgaaaagtagtatgccaccagaaatagaaaggatttcaaaaagactgttgttttttaattgttataggaagattttttggacgaatcttgtgaaaaaaaagcacttctccttaacacggtaagactacaaatgaacacaacatctgccacaaaacaaaaggaacacattcactaaaactgagctgtttgatcattttaccaggtatcagaatattcaaaataagagaaacgaagttgagggtgaaaaggaacaaatttaaagtatacgatttttactatacagaaaaacgaatgaatacagatcagcacatcttgcaaagtatttcaggtcattatactttatattgtagcccaattctccagcatttaaacctggacattcattttttggaattatctttcttaggcctaattctctaaagatcttgattagtccgtatcttcacataatttgtagaaaggaataagacaattaaatactactcaaaatagaaattataaagctaaagtctagttagttgttcaaagatatggcattgttcgtttcccagtgtctgactagggaacacacctcagagccagcacagcccagggttaggctgataatcaaatgaactttcaaacttcctctttacctcaaagcaaagtgcatcagaaaactatagaatgggatctttttgtcccagctcaatatttacactgattctgaaattttagcaaagagttatataacccatacatcttattcatagttgttccctttgagaatcagaaacaattcaagtaataaatgaggtagaacacaggtatatttggccgtacatgccatgaagagaactcattgaacacatttaagaagttctaaatctttcatgaactaacgtatcaaataaactttttaaataaaataattaattcagagtttggcaaggaaatagaagtctttttcttacggttagccaaaaattgtcttaaataactagatttcattacactacaataaaactgaatgaaaatcacaagtatgtacaatatacatcatcacttagtatgtcaaaaagcatattaactgaaggagcatatatttgcatagacacatatacacatatattactttttttaagttgcatgtattcaaaggaagaagaatttacattcgatttccaaagcaatggatctttgactggaagtattaactctaccatagaatattctatcagtctattgtaagccactgaatcttcttttgttagttcatttcttcagaaacggttgatacttttactaaatgccaactatctggaatatagaaataaagtgacagtccctgaattaaagaagcgtacattgttagaggagaggcacaaaactacccaaaactcattactccattgaaaattattttttaaaccactgtcttttaaggaattaattcttttacaaatttattgcctgcacagcccaggggtaggcttattatctggatgatctttcatttatttctctttctctctctctctctgtaagtatatatacatacccttagtttaacacagagaagcatgccctaaatgccttaaaataaggttgccagatgaaatgaaggatgcctatagttaactgaatgtcttgtatttttatttgccacatcaggcaaccattctccaaaactcccaccagctactccccacagtgattattacaactctaaagggtagagtgccccagagtcaaaacccaatgagaaaggatgaacaccagccattataatagctgacaaatactaaatacctagtgctgagaaacacacaaactgaatgaagagcttatactctgctttaacctaatttgaatcttactcaattctcgtgtgccctggctagaaaataatttcgttcaaaaataaatttttcatttcctcctgttatgttttagcttctgatttctatcataagagccttaaatggtcatggcttgagctcaatgtaaaatattctgaacacaaatcttggctttcttctttaattataaaaagtgtgaccattatgtagctgttcttgtatatacagaaatattcagtgttttaattaggcttactctactttagtgttaaaggaagcaacaggcctgcgattgcctgggcactaatagtacataatatagccaattgcaaacagcagtctaatttgttgatttcaagtgaagtgtaattatattgcttcatttgctgagcaaatcatacgagagtttctctaaatcagcctgattgtgtaatgaagagctaattacaaacagcagtgttcttgcagtaaatttattgtaagtgctaatgccaggttggctccattgtgacaatggctcattagtacattagcaaaagcaactgtgggaaaatgcccaagcagggctaccggtctctcagtttcagaagctgcaatgattacatccttcaacatgtaattactaagaaaatggtgtttgatttaggttttggcaaatttttaaaaagaactaaaagacatttttagagcaaaatgaaatgattcggaaagccttcttgtcaggcttaattggtgcttcatttcaccaggtgtgccctggaaaccgaatttaacaagaggctcttttagacactaggccattcttgacaactgagttctcacatttcctcatccacatggaatctatgacttaaaagaaatacatacttatatgtacttcaacatatatacttaatacttatatatataagtatatataaatatgtatatacttaatactcatatataaatatatatacttattcctattcctacttatacttgatatatatatatatatatatatatatatatatatatatatatttttttttttttttttttttttctccttgcattgaagtgaggtgagtcaattaagctcctgctagacaaacaaaacaaaggatcagtagctacacatataaccatgttatctcacatcctaatgtctagggttttttattctaatgaagtggaaatacctgagctttgtgtcttgaaacagccccctactccatgcagctggattttataaactaccttgttcagttgagccagttggtcttaagacggcccttatgccatttccctaccttcaccttcagagtaaccaaaactgctcatcaatctcttccttttattgattttttttcatcacaaagttttatttatctgtgcttatcctaacatgaaactttaagatgcagacttttctagaatccttaacagtttagtacattgcttcataaactttagtagggcattcacggaagagccctctcccaaggatattgatagtattgtgtctacaactaatgtgttaattaatttttcaaataaatttaaatatatttttaagtaatgttattgaatattcagtcactatgccctgaaatctaaatctagtcttattgatctctaaacactttgattctctctcctaataaggaaaaatcataaataagcagacatgcaaagtttcaatgtaggctaataggtataagtgtataagtattatgtatatattaataatacacattttatctgtctctgtttatttacttatttatttatttgtttatttattttgagagggggtcttgtagtgttattcagaatgaattcaaactcctgggctcaagcaattcttctgcctcagccaagtggctgggaccacaggcatgtgccattgcactgcacagaaatacatatattttagaaattaaaaattaagtcagaaatatattttagtggataaattataaagtcaaaaatgcatatgcatgctaactagaaaatttaaataatacatatatatataaatgatgtttgtatatacaaacatactcattgtcccttttatactgagaactaatggctttagtctattagctgcacaaaaaatattgtcttcaagagaaaaaaataagactattgaactgaatatcagatagctattcttctgttcctaaagacctaaccataaaacaacttagttgcctgagttcttacaactaattagtgacagagcagaactggagatatttattttctaatggtcagcccacttttctgagtttactaggctaaatttgtcatatattgtggcctctatccaattttgtatcttaaattattgctataataaatatcaatacttttcaaattttacatcaaacaatatttctttcatcctttagatttaaaaagtttatttctatttttaagtttattcatagtttcaataattcaagatgagaaccaaatattaaatagctttcgtgtctttaaatgtgaattaacgtccagtttatcttgttctctatcttctcccaacaaatgattacagaaatcatctgatatctatcattatctcttttttaaaatcattttaaatgggtcaattttatttatgatttgtgtgtttaaatttttattattacatctcttacagcaaaatttatagggtttccaagatctttcaggatcatccaaaatgcatataatctaattctgctttttatattcgcactttatcattgctccatactcatgcttcaaatcaatcttttaattttcatgtttatgattgcttatcatattatccaatatgcacttcacaggatcaataatctgatttagggtgtaagcaggaaaactaagtgaatggcagtaggccaatgattaatgatttggtccgtgtagaaaacaacatttattcaaaaatcacagcaatgaagtaagctgaactaagtgataaaaaattcatgaagatgtaaaattattcaggcatgtggcagattctgtggcaacaatgccacaaacttatattaatgtctactatgtgcaaatgtagcatttctttcttgggcattactgtcatttcatatatcaatgcttcactgttttgatttgtttagaatctatttgaataactctttgtaagatattgaacttcatattggggaaaaggatcaatcattgtataatgaattcatttttggattatgtctacacaacgaaacaaaatgaatatttgctttatttgatgattcaggcacaaggtccattgagtttgtgggctgaatgattacatttgactttacttgaagtaaccatatacatcattaaaacacataccggttttttgtcctatgcagaattagcctcaataaagagaaaatggaattgaatgtttagctaattccatacaatacctatgctactgtataatttataagcagcgggtagcctaagaatataatgtttttcttcaagattaatgtgtggaatacaaaccaaatctttcttctaagagtataacttgccaatatattattttgctaaacatttttaaaaggattattgaaacggtggaaaatatatagaaggccactttaggaaacactgcctttttcttgctaatacataaattgtagccatttgttctttttgccacaacctttggggattcgggtgaaatacttccttcagaatgtttcttggcatcccttatttttattgacccgtgaacttgaaagtctgtcataagatattattatgtgagaatagtggaaatgtattccattaaagcaaaatctctatatacagaatccattcgagtgctatcatttgtcttctctatgaattttctatctcaaataggaatgattgtatgcttaatttgttatttttatacctatacctgtacacatacagatataactgatggtatagtatagacttttagagaatgaaaaaggcctgtgtttgggatttgaataagtcccaacctatattagcatataagcaaaataaatttaaaaaatatatatctgtgtgtgtacagaagtagacacattttatcatatatttacatatgtgtgacataaatataaaatgtataaaaataaattatatatttgaaatagaagcaactctacacatgcacattattatgccttccctctgctgttcttctcattttttttttcagattctaccctcattgctgaacccaaaaccataaactatttgaggtaaatgctaatcatttgttgaattaaactgatgttgttagtaggcgaggaaatactcctctgttgttgctttagtagaaactgtgggtggaaggacacaggagaaaccactgctccgatgacttgctgacactggctctacttggctgtattccacttttatgactttaagatttacaccaacagtttctctcatccagaagtgtatttttaccaatagaaatcttcagaaactgaacagtgaaatgcatcaacaaattatgttcattattttgaagttagtagcaaatgttagaaatcacttactatacactgtactctgttccttagtattattaagcctttttaatttaaaagatattgaatattttcagttctaaaatattttattaagagcagaaacctttaaaatcttgttattgctactcaaaaagaaaatatttgtaacatctgctataactagctttaaaataggtgattattagctaaaatgcctggtaaattattttcaaaacatgtatttcagttgaagactaaattagtgtttaaagcagccaactggtgatttatatcccaagtaagatattccaattaaccagcagttattattgatgctactagtaacaacaataatcaacagttagacaaagtttggtaatagattttttagggaccccattatcaatatatagctcataggacttaaagtaattacaaataattattatattgactaatcaaatatctaattttttgtaatgcatgctactacataaaacaataactggattttatagattattagcctctgtactgctttgtgtagtattgcctattagttggtacttgttcttagtctaatgaacttacaatcacaagacatgtaattctgaatttgcatagctctaatctcatgaatatcaaaatagaaacttcggatatataatactaatgagaacatttcaatgaggaaaggttactataaaatataaagtagaaaaattttatttgaggttacattccatctttccatatacatttcctgatgttggtatttaatagctaaaacaataattaacaatttttggatataattaaagcaattactgtatagtagctagacctgcaggcatcaacatcctttgtctattaattcaaagtggccaggtatgacttttgaacctgtattttaactgaaaagaaagaagttcacatttgttgagcatctataatgtgctaagcactgtgttagatactttttgtagactatcttgattaatcaacacatctattatgtgaaacaggtagaaaccaaggtttataaatgtgacaaaaatttatttctagatttttctacttttacatgttatgctaattattctagaatactcataagaataaatctttattcattaaaaacaagataccacaatcactttcaaaatttaaattaaaaatttttattaactttttgttatttgaaatagcaatatcctggtatttttatttaatgttaatgaacttatacatatcatgaagcttattttactatgtattttttccataaaacttaatttactttttggttgtgttaaatataaataaaatttaccatcttaaccatatatatgcagttcagcaatattaattacattcacattgttgtgcaaccaatctccagaactctattatataattttttaatttaacacctgaatagaaataaatttagggaatacaacaggctcataatcttggttattgctccgaaaaatatctcttaaaatattattggtctttatgtgaggcaagcactgccataacactgcattgcagggagatttagtttatgccaccagttttatataggaaatgtgacttactaattagctaactgccttaatgtctgggtgagtcatgtcatcccttatggtctgcaaagttattcaatgaagtaattttctaaccagaaatgtaactatacttgtttggtctcttcaaagaggtcccagaaaactaacttaataaataaataaataaatacaaatgcatctggttttttaagtttactttggtaggtgtagaaatacaaacaccatcagttaattgtactgggcttttttattggctcttttatttctcactttattttctgggttgctttatgatgttgtgacacaatgattttccctcctaccccctcatgtcaacaaagtttatagaaaataaaatatctttattgttatataacagcacagcaggcttcacatttattatggaactaaataaatgcaagagtagcttttcactttaggcaaaacaagccacatttgaagagaccctgggggttaaaatgtcacagattatgtacattcgtaaaataatttctgattaaatgaactatgctacccccatataaaaggaacaactttttgattttttctgaattttaattgtccttaatatgtaaacatgagtgtgtttagtcagcaaacatgaatgtgtgtttgctgatgaagtagttacattagggccaaagggcttttaatggagtaagaaattggtgaagatttatatgaccactgtggaatatgctcttgttatggaaaatgatacctgcctctttactaaaagaaaaaaaaacaagattaaattaactgatattggtgatgtcgtaagccactaatgcagagtttgagtggtttagaaatatcagaggaagctggtaatgcaattactacattagcatgcagttggaatctggttttcgcctgcagaataaactccaatgagacatttatttgtccttgagtaatgataattgtgactaagtttcccacctgaaagaggctttcagtgaaattgtcttttcacatattacatggaagaccagatgtttgaaagcaatgctgatggcgtgctttctaacctttttcacctcactggacatgttgaaaaaaaaaaaaaagtacagcacactggaatatacagaagaggctttttgtagcctcttccagttgtcctaagggctgaagggacaaaatcttggcttagctgcaacctgcctgggacacaccagtatgctatggaacataaattgagaaaatgtatacagcattcatttatccatgtaacatatacttctttagtacctactatgtgccagttgctttataggccctggggataaaatagcgagaaaatcagacaaaaatccctactttcatggcgtttatattctggggggaaaatagaaaagtaaaaagttaaataagggaaatatagcacattacatggtgatactcttaagaagaaagaaaaaataaaacaaggagtggagcactggaaatatattttatttatttattatatatttatttatttttagttttagttttttaaaaatagggtctcactctgtcacccaggctggagtgcagtggcacgatcacagctcactgcagcctcaacctcccagagttcaggtgatcctcctgcctcagcctcccaagtgcctaagactacagattcatggcatcactcttggttaatttttctatttttaatagagactgatttgccttgttgaccaggctgatctagaacttctggcctcaagccatccactcaccttggcctcccaaagtgctgggattacaggggtgagccaccacgctggatggaaatattttagataatgagatcaggaaagccactgcctggcatgttctcttggttaattgtaaggtggctctctgtggttcttttatctcaaagcaccatttatgccaggagcagggctgtgtatcagaatcagcattagcagaaaccacagatagcataacgcaagcaaaatatgcttatagaagtccagatatctacagacttttagttaagacaccttagataggttttttagagtttagttttgaaatattttgatagctaaactttctttttccaaatgaaatcatagatgggcacaatgtaaacaaaaataatacagctcagtattaagcagaaagtccttcattgcttgtgaaacctggaaatcaattatttcacacccttatgattcttagagacatcatttagaaaatttattcattaagattgtttttaacaacaagtaacaaaaaaatccagcctcatagtcttaacatgtttttgctcatataacaaaatcagaagataagtggaccaataatgttaaactgatacctccagattctcctgtcctctgcctactgctgactgagtcaaaaaatgactattacagctccagaaatagagccacattctcagcaggaagacagagaaggaagcagcagtgcctgtcatttcaaatctttcatcaagaaagaaacatttttcagaagttcctccatccccagcctcagaagactcccacttagttctcattagccagaagtgaatcacataactattcatagccgagtcaaactggtaaagcaaagaacagggaaatcctgattgacttaaacagggttcatcacatgggactgggtttctgccaccccaaatgaaagtaagtttctgtcactccaaagaaaggaaaaaagatactgcattggcaactaagaacatctaccacaagtagacactctataacagatgtagctccacttttgattacagcgtcttgattttgaaattgcatttacactctggcaactaatatcataacattgccctagaggcaattctaacgtaacataaaaattgggtctagcaatgcataatacttgaaagcaattgttcataagcatatgccataataacaaatattcccctgtaggttttcaaaataaatgaaaagagatgcagatggatctgttttacagccaagtatatttccacatggcagcatgaactgagattaggcataggaattaggcttttatgatgaccaaaattgtatgtgctagtaactctacttgacattaaaggttgtaatttatcttctttgtattagtttttttttttttttttgctatctgtgaaactggaataacattctcatccttgtagggatcatatagattacctgaaagggaaaagtgccctccatttccaaagtgctcaataaattacatgcattaaattgccataggtttgtttgacacatcagaaaaatttcactgtttttcttaagattccctttccatttatctttatttcctgatctttccccaaatgtctaagaatatgaaaagtaggtctgtctttcactgcctgcatagaagatagactttatctatatcaattttgtgaactgtgaaggaactttatgagcctgtttgtttggaaactgaatcacagggaagttcggtatcttcaaaaaataattgttaatttatagggcatgttaaggtgtttattatttcttattccatttgtttcctcacaattaatcctaatttctattttcttacctgatcacaaggtaagatgtattgatatactagaagcacccaaactagtagtcataagatattagtttaatagtggcttatcattgattagctctgttaaccttagaaagtcatttaaaatctctggacctcaactttctcatttacaaaaataaggtgatgctatctttgctgcttttcgtacagaattgccatcatccaaaatgtataattatattttccaaattccacatatttccaacttatatgtgtatacacaggcagatttgatataattatgaaatgatttatatctctaaacccaatatgttcaataaaataaataatatttagcatccccagatgctaaatattcgctgtagattttctttcaatatagaatgaaggataatttgatttgaattttctatcgtatttcattcacacgatgatctgtaggtttattgtcaaatagagcacactactcttagcggcacactgtgggattcaattttctgtagattcctagtttttaaaaacaatcgcatttttaaattgccagtcatcagaaccaaagtcctttcctagaagttcttgaatctttgtgtctttgttatctaaaacttaactccgtcacctactgaggctatctcaaagcactcagatttaagtaggaagactttactcatcatatggttttatcctgaggcactttagtcaattgaaagggttttgttgttgttgttgctaaattgtgtatcacagccttaaattgacttttatcttgagttgttttaattaatgtgaaggtattattgagtcttggtcaataaaagtctcttacaataacatcctttttttcactttgcatactcacacatttctgatgtctctatttcttttaatttaggcttgttgactgttaaattctttcttgtaatactgtgtcaaatattatcaatagcaacctttgcttgctattaagtttctatttccagacttttccccaagaaatgaactttctgtcgtcaaagtaattacagaaagcattttgaccaaatattttgctatcggtttacatggctgagcaactttccaaaatccaaaagtaatttgttcacaactcatgactcaactgctaaggcaatgcaattttgtctagaaattttattagagtctttatccctgaatcagtttcagtattagctacacaattaacccccaaatctcagtggccagtagcttatcacacagaaattcatttcctcttcatattctatgtccagcacagccatgtgagggattctactccacacaggcactcaaagctccagtctgagggaggctctgccccttgtgatgccatgcagctctggattaagtactcatggctttttgccctgaatggttataaggctcaaatctaactaaaacgtaccctgtcgaagaaaaacgacactcactgaatattctgtgagtacttttgtctttgccatgtagcaggaggagctgcagacaagaacccctcagacaccaagctgtggaaggaaagggctttattcagctgggagcatccgcggactcacgtctccaaaaaccgagctccctgagtgagcaattcctgtcccttttaagggcttgcaactctaaggggggtccgagtgagagggttgtgatcgattgagcaagcagtgggtacgtgaccgggggctgcctgcaccagtaatcagaatggaacagaacaggacaaggattttcacaacgcttttccatgcaatgtctggaatctataaataacataactggttaggtcaggggtcgatctttaactaccaggcctggaacgtagcaccaggctgtctgactactgatttcatttctgtcttttctttaactcctactttttctttgaggcagaaattgggcataagacaatatgaggggtggtctcctcccttagccacattcacccagatcaatttgtatgaaggtctcgaaatgtatggggatacgattcaataaaagctcaaagaatttttgctttaaaagatttttaaagaatcagacatttagagtgcaggctcagaaagcacaacattagacgtaggtgaagaaataaccttattagtataggtctccttaacacctctagcttaaatggattttaaatcaggaaaagaaaatatttctgaattgtcaaggaataacagtcttcaaaactgattcaaatgtagtctaacttttcaaagaattccggcttacatctagacatctgtgtctccttgtcatatgtgataccacataaaaatagtgcagtaagatattctttcaattgtgtattttagaagagataaacgaatacaatgaccattactgtactcaatttttcactcttcatttatctaagtgtacatatttgtaaattaagtgagaagcccccacctttttcataataataactaaaatcaaggatatttatatgtgccaagcacagttcaattttgtttttattgatactttttattgatataaataaagaggattttaattcatattagatttaaatatataaaaagtacatacaagatttaatttggaatgaacattttttcctgtaatgaatattttaattaagttaataaacccttaaaagtagagatgattatagtcatgtaaatgtggtttaaaaagtagctgatgacacttgagacacaaaacatttaatttaaaaatgagtctcctttcacacttaatttctttttgtcattgtcttttcacagaaattaaaaacttgtataaaaacggggtaattgtttccttcaaattcataagcttgtgttttataatctaccataaaggtttcagtccatggtttataagcttataattgtttgcagtcactgattataatttcatgaataaaaattgctttaggtaatcaatcaataggaaaacattatataaatccgacttttctcataattggctttatagatgaagtatataaaaaagtgagaaaccttaatattgtctaaaaactcggtcattcctgactctgattctccttctgttgctttatgtgtgtgtgtgtgtgtgtgtgaaccaatatcctttcataatgaaaaaatcattttttttaatgtagctgttctttttgtttctttcaaagacccacttcactatccaatgaaagcaatctgtggccctcattctccaagggaaattatgcacagaattcaagcctaagacctcagtttgttgctagaccctggctaaatatcttttttcaaataaaatttcttaatttgtctgtttatacttgggatagatgatgcttcttcctctgggagttcgggaccagcctggccgacatggcaaaacttcatctctactagaatacaaaaattagccgagcatggtcacacatgcctttaattccagctacttggaaagctgaggcaagagaattgcttgaacccaggagacagaggttgcagtgagccgagattttgccactgcactccagcctgggtggcagagtgagaccctgtctcaaaaaaaataataaaaaaattaaaatttaaattgaaaaagatattgcgattgtttttctgtcactagatagttgttcttgactttttgtatgctgcttctccatcttttggaagagagtatcaagtggaaacttaccattctgttgtgtttgtttttagcagttattttgaatataatgctacagcaataattaaaaccacacctatgcatttgatccatgaaaagaaagtttctcagcactgctgcagttaagtatgaggtttagagggtgaaaaattactcaagtttttttgagtctgtttcatttttgtgccactttataatacctctatgactttcagatgtagtcagcagcttcaccccactaagcgtcattaatccttctgtgctgaacattttgtatagtttacaattgtcttactctttacctaatgcataggcaaacagacaacagtagttaagacaccatagcaaagttttcactatgccaaattggggtaggtgatgtatttcatttattggttcttttattgttgtttaaaatttaaaaagtaaaacttttttttaggttaaaggttattttcaagatgtttgcattacattcagcttcttctatgttcagcaatattcatttcttaccctctcattgaagaatagtgtacttttctcctacattgatgtagggcttggccaatataacttgttctgacagatggaatgttagcagacataacccagcagggccttaaatgtattgggatcacatgacttggcttctgtaccttgaatgacaactgtatgcccctttggtctgagctccaaaaccttcacatatggagcagatctgaacccatcctatagtggggaaccaagccaagtcaacccacagcctgaggctgagggaatagccaaatccagcctagatcatccaaattacaatcaacctgcaggcttatgaccaagagaataaatgcttgctattgtaagtgactgcatcttggagtagtttgttataccgtgtcattgtggcaatagccaactgatagaacatctaatattagcattcttgcatgttttcattatactccgatacatgggtttaacaaatcaatctatgtgacaaaggaggaagattatatccacattaagatgtacacagtacagtgatttccgattctcaacagcattgtccggagtcatcaacatttttatttaaaggtgattgttttcataataacataatcattgaatgtcttaaaggattattaaaatttttaaaaagtagttttctacgagatttatcaagcaatagggaacttttttagttatttgttttcatatcggaagttttactatgaaatcaattaatcaattgaccttttatcccttgagaactttgttgttactattgtatggatggtggggtggtatatgtatatttgcacctttatagtgtgtgtatgtgtgtgtgtgacataactttgtagctagatatgttcttcaagacaaatgaatttcatgaatatcgagaattttttcaagaaaataaccctaatatgttacctaacatcctgttgattaaagaccaggctttcaaaccaaggcaacctaggtcacagtcctggcatggctctttctggctgccaactttggtgataataatgtttagctcataggttcattgtgaggataaagtgtgatcgtgtatatgaggcaaagagcagagtgcctggggcacagaaactgctttattaaatatgattattttagttataatttattggatattttcgatttctttctttcaaagacatcatctgccttgtaatgtctttgcaacatttaatatatttagcatagtgtgaggcactttggatgctcattttttacaataatataatagttacacaaacttaagctactgcccataaacgtttctggagtgactttcgaattgaggctttatgaagttaacaaagaagagtttatagtataactaaaattgcaatgagaagtgaggacgacatacattttaatagatgtaattctgttgcacactgtaaaggatgtggtgagagttttgtgtctgtctacctccttctcacacataaatttgagtgtgactaagagacatgtcccagctaggctagatcaactgaggacctctctcttggttcaatgtttatttgcttacttttatggcatgctttcattgcctctggcttttgtttatctgtttgtgtcagcactaactgcacaaaagtttcagaatttcttcaaatatcatttatgttttgattctacttgattctagacatttgtaagaattttgtgtgaaaaaacagagggatgttaattttaatatgtccttgattaaagactaaactttggatatcgtaccattatgtgcttatttatggaagtctacttgtctacagtaatctgttcaaaagtgagccatccattttactaaataatagaatggaactcatgtaattttctctctttattgagtttttacagtctaggctcattgtcatgagtgagaatttttctagcaaaagaaagtgacatgaatatcgtgataacgagggtcatttcagcttacattgttaagaagattccccttctacatagcattagggatagtccgtggtgtagcaccatagcacatattgtgcaactccataaaaagtcccgtattgggagcagtaactcccagatgttatttgtaattgcttcacagcatagtgaattctacacaagcaccacatggtagttcatgcagcaggaagttaaaggggaatgtgttttttaagtgatttagtatgaatgtaactacatatggagagtaataggcaaaggaaatttggaagagattgaattagttgtacatccttcctggtgacattctcaatgagcctcaacatgatggtagctctgaatgtctcatgtactctacatccaaaacggctcagattagaagagaaaaatggaaaaccttgcaatctaaactttatataatattttaattgctccttagtatatatgagttcaggcaatgttgtaacatattgcagcactatttacaacagcaaagacttggaaccaacccaaacgcccatcaatgatagactagataaagaaaatgtggcacatatacatcatggaatacgatgcagccaaaaaaaagaatgagttcatgtccttttcagggacatggatgaagctggaaagcatcatcctcaggaaactaacagaaacagaaaaccaaacactgcatgttctcactcataagtgggagcttaacaatgagaacacatggacacggggaggggaaccagggcctgtcagggggttgggggcaaggggagagagagcattaggacaaatacctaatgcacactggacttaaaacctagatgatggtttgacagcagaccaccatggcacatgtatacctgtgtaataaacctgtactttcagcacatgtatcccagaacttaaagtaaaataaaataaaataaagtaaaaataaaaaatggcaggatatctctatccctgtcagagctctgatactgtataatattgaatacatttgcctctaaatttgtttcctaatttgtaaagtgaaaataatcataatttacaccacagaagttaacagataattaatataaagtaggatagttccagtcatattggtgctcagtaattgatagctataaacattggtgccagaatatgctgtgtgctataatatgctggatacttgatcacataaataaaattgtattgtttgtataagtattatagaaaacttttaatggctaagagagaaaaataagggagataaaataaaaaggatgagaaatatatttataaattcataatttatagatataaatatatagcaaataattttaataaatgttttagagaaaactgtaaaataaattcttttaaaaattacatatgtatataagcaataaaactttaaataactctacataagaaatgttctttcaaaaattcttgaggatgtttcaggtagttctccatgagggattagtaataaaattctgttgaaataataatgaggaacacatttttttcctgacatttaatctctcagtaacaggagagagctatattgtctcccatggctcctgaatatttgcccccagacatgcataaaatagttgtcatgtttataaattcattctttgttgttatttgaaaggcattaataatagagtgaagaactatttttgaaccgtttctagctgtgtgaaagtgtgtttttaatctaatcaaaaaattagatgtcctcaaatgcacttcttccattgctgtctacttgtcaatttctaatgaagaccaaagaaagttattcactattttttgtgcctatactttgcaattccttagcatttctgaaatagcttttcccctgcaacaataacaacctcatagaatgatgatttattcctccactagctgtggcttcattcctttgatgttttgcagcaaaacttatcaaatagttgtgtatattctctgtctccaatttctcttctggacttctctcttgaaaatacttaaatgaggcctttgccctcattgcactttcatctgttcttgctaaggataccaaatggcttcatgttgctagatcctatggtaattctcagtcttccctttgcttgacctatccacagcctattatttttataataacaggttgacctattatttgactaataagttttcttcatttggttacaggaatgtccaaccgtcctgatgttcctccttctagtttccttttctggttcctcctacactctgccacctctgattgttgaagtgtcccaagacttcgttcttgatgtctttttcttctgtagcttcacttagtcccttggtgatatgtagtctgctgactttcatgtcatctagatgacagagactccaagacttttatgtctagctcagatcttctcccaaaatccagactcatatattcagtaatgtatttgtcatctccatttacaggtctaatggataatccaaactcaacatatccaaaactgaattcctgacccttgttccaaaacctattctgccacagcctttcccagcttgattcatggaaactccattttccagttgcccatgagtaaaaccttgaactaatctacctcttccctctattgtacattccacacttatttccggattaagtgtaggatgtacaatagagggaagaggtgattagttataaaatggtaaaaaccaaattgacttcctgttgtctacctctgcaaatgaagaataccaaagtatagatatttctatacctatacctgtagaaatctctatactttggtattctacatttatagaggtagacaccaggaaatcagtttggtttctagcattttaatgcaaaatcccatcacttcttgccacctctacatctccactctagtctgtgctaacatcattctctgacctgggttatgcaataacattgtatctggtctctgagatttcactcttttcttcccagtcctttctagtagccaaagtggttctttaaaatatgtcacatcatatcatttctctgtgaaaaacccaacaatgtctctgcatttctcacagaacaaaagccaaggtgcttatggtgatccatttggcattacctaatttgccccctttttttaattaactgcctgacctactctctgacaactcttcccctcattactgccgcagtcagtacactggtgccttccttatccttgaacctgccaagtgcattcctgatttacagaagtggctattccatgtatctggaagcctcttctcctaaatatcctgataactaatattttcacctcctcaaaagcctaccttgactacattatttaaatttgcatcctgaaatacaacatcaccctccacttacgttttagtaatatttatcattgcctaatatatcatgtatttacttacttataattttttcctctactttcctgctagaatgtaagctctaaaaaggtaaacatctctgtctattttattcactcatgtatactaaatgcttagaaccatgcatagtacatagtaaccactcaagaaatgtttgttaaatgaatgaattaggtacagtaagggatagtttgatttaatggaaaccactgtctcttacaattataaaaagcaaagcaaaactatagtaagcaagatactctatatccgtatcttgatatagagcattgaagcattgaaggcaagttacttacatgcctcagctttgttgagatacaattaatgtacaaaaactatacatatttaatgtatacaaaaaaagattttgtaggtgatggagatgttaattaccttgattgtggtgatagtatcatgagtgtatatatatatgtccaaactcaccaaattgaatacttttgatttttgacttcagcactaatgctgtgcaccacatactaagaacattcaactatgcactgaattttaacttgtaaattttttgattttgttattttttaaattttatttatttttccccttttctgtggtgctgataactttgcaattattttgaatattttacatatcatgagactttctttcataagcttagtttttgacaaatggattgattgatgaaattgtataatttaatggttctacacattctgcatgtctgtatttgcaatatttgcagtagggccaaattgtggcatgttaatatacagaaatttgtaataactgtaatcattagaggaagtgttttagtgacggtgagctaactattataaaaaataaattaaaactataaaaacgatttaaatgtaatagaaatgtgtttctaactcatgtaacaaccaagatgcctccagttcagtgggcggagggtatggagatgagcggctgctccatgcagttattcatggaccaggaggatagagactcaaacattttcagaactccacggttgccctgatatcaatatccaactggcagagaagcaaagaaaggtttttatggtccagaattggaagtgacatatatcattttagctcttattccattggctagaactcagtctcatggccatgaccaaatgcaagagaggctggaaaatgtactcaaagtatgtgttcagaaagaagagatgaaaaaataaaattgttttcaatgactagaaattttagtcatagaaaactatgcaagtttgtcatctcaaagccagatgtagggaattctagtttatttcaagcatcaagtgtggtaaggaaaataaaactcccaacattattatgagctttattgcatcaaggttatttttctgcagtgctgacttatttggaatgtgaatttatgcatatactacagatgaaaagtatcaaaattctaatatgtctgtatcttgaaataatgagtactacagtatagcacatatattggacagaactagattcttttctaataatatatgtgaacaatgcatcttagttatatctatactaacagagatacgctatggcacaaatcacacaaaggtatgcaatgaatatgatatcctactttcctttctgcagattggtggaaatcaacaagctgaaaaaactaaagttcaacatagtgagtaacttaaaagtcataaatttcttcccacatgttttcagagaaggcatgtgcatatgtgtactatgttcttgggtacgacattaatgatgaataaataatcaatactttttgaactttatggagaggaattttattgaatgagttaatatcttaccaaagtacacactgagaaatggggaacaaagaaaaaaattggcaaaacccctttgagatactccaaattttatatgtaatttgaacaagcatgactgatgctgtctatcacagaatacaccttctcataataagagcaaatagtaccctagaaatcctagaagtttgtggaatattatagagaaatgaaaattggtatggcaaataagtttagggattcatgttctgcttacatcagagaccttattaagtagttaattaattttattttagcaaaataaaattatgctatgtttaatgtcaataaagaagaaaagaaaacaattctactgagaaataattctagtatcaaaccattctatgcatatgttagatgaaagcctaaaaatactctggagtaggcaaagttgtggattttaaaagaatctgtggacttatagaaaatgtgtaatttgaaaataaagtagcatggtattctccttgctctgattgtcttttagttattgaatataatttcctttgtattttaaatgacgatattaaaaggagcatgaggattttatatttatcacatggtggcatgtgttttcagacaacaaataatattttttctcttcctttggcatgattataatataatagaaagatcaggacggcactcaaagactggttctttaagggaagggatcatgtcttctttgtctctatatcagtatcttgtacatagtggctttgtaactttactagaaatgtgatgaagcttctttgagatatatttagctattcaatgaggataacaccacaattaattgttaaaacatctatgaaataacattggtgaatctgtagtccatagcagagtttttttaataacaataaatagtaaaaccctgtgttgctctggccaagaacatttaacaatatcacacaaggactataatggcaaccacatgggagactggctttcagctttcatccagtttctaaatagtatccccggcacaaaaacagctgaattttaaaatgccattccattattatggaggaaaagtaaaacaagcaaaatagagaggcaggacacagatgcatctaaggaagagagatgctgaacagaacttcagatccatgcaaacagaaataaacaagttagcaatttgtaacaagctgtctgccatttacaaagtacaggagggaagcatggtttatttaccgatatagctaatgtagaatctgaccttatattgaatgttgattcattactgacatccagactggattttcctctagtaaaaatagcagtgccactaggctgaagagaaaatagcatgggcaaccacagcacagttagcagaatctaggtgacaaagcaagaggaagtcagactggactggcacagaaacattctctagccaattcttatgtaaggactcttatatatatatatatatatatccaaatacattatctcgtattctgtgggtcaatgtggttatcaaagtatcattttatgtacagcatgtatgtaattatgcataaattaactgaattataaattatatctcattcatattctgtagtttgagataagtcattcaaccaagtcttgttttaacttcataaaatgcaaagttttataagagagagaagaaaaggaagacagaaaggaattagtctgcttcacgctgctcataaagacatacccaagactgggtaatttataaaggaaagaggtttaatggattcacagttccacatggctggggaggcctcacaattatggcagaaggtgaatgtggaacaaagtcacatcttacatggcagcaggcaagagaatgtgtgcaggggaactctcctttataaaaccatcagatctcatgagaattattctctattacgagaacagcatgggaaagacctgcccagatgattcaagtacctcccaccaggtccttaccagggcatgtggggattatgggagctacagtatcaagatgagatttgggtggggacacagccacaccatatcagaagggaaggaggaagtaaagaaacaaaaccagatgtttatgtgtcagacatgttaaattgtgctcaataatgttaggaaaaaatattattaaatatacaacaattaatgaagctttcacatgctttaataataaatagggaccaacagcctattttaaaagagatattaattaggttaaagtcccagaatgaactggaaccatgtagtttcacaatcattgttgaaccatgtctgaactttttgactgtgacaccgctatgcattttgttggtattaaaacaccgtaactatattttgaattaaaaacaaagataccatcttaacagataaatatttttgagaaaaggaaggacatatttgctggtttattgcacatataaggaaaagatattttactgtctatcaataaatgcaggttcctttgaaaagagcaaagagagtgtcctcatcaagataatggagggtagaactaatttaccctgcagtatctatttgttgtctgggtattctttggcaaagacttattaaagaagttgagaaagtttggcagacaaatgcattatgttaaattacttaagcatacatcatttatgatgtgataatttcagttaccatagatcattaaaccaaaatttttagtataactacttttgaaatattaaaatataaaaatgtcatttatgttttcactgttcagtaataacagtttcctaaataccttttaggtagaaataggagctagttaagacatgaattttaggtagatagatctttttgtgaaaattagtaacaaaataataaaatcagtatatctgaatgtgtatgaaaaatacaaaaagtaaaatggcgttaggaaactgacaactatttacttgaagagtccataaaatctcctttaaattgggagattaaaatgtaaaataaagtattatgacacatagtatgattattagagactctctaacaaaattgcatccacagatgcttgcattaccatcagtccacagctatgtcccacggaagggcaagcagaggctaatagctgccaaatctcttagaggattatttgtctcattgatcctgaaaaatgtatatgccattttgtctcacttcaaaatacacttaagtcattttatgtccttttaccttcacatcatgttctctgtaatgcaggctttgcccttattttaatttgaaaaactgaaacggagatatagagatagaaccaaagaatcaaaattctgcacaatttttttccaaagtattctgccatcaatgaacgaaaactaaagtatgtttgttaaagaatcagtagaaatagatcatcagctgtcagattcaggggtctgactctttggacattgccttagtctaagctgctataacaaaatgccataaaatggatggctcataaaaaacagaaatttatttctcacagttctggaacatgggaagtccaagatcaaggtgccggctgattcggtgtctgctgagatcccgctttctggttcatagatggttaagacgtcttctcactgtcttcacctagtggaagaggcgaacaagttcttttataaaggaactaatcctattcatgaaggcatgccttcatgagctaatcacctccccaaagccccacctctttattttattttgttttattattttattttattttatattattttattttattttattttattttattttttgagactgagtctcgcactgtctcccaggctggtgtgcagtggcgtgatctcagctcgctgcaacctctgcattccgggttcaagcgattctcctgcctcagcctccagagtagctgggactacaggcgtgcaccactacgcctggctaatttttgtattttcagtagagacagcatttcactatgttggccagcctggtatcaaactcctgacctcatgatctgcccacctcggcctcccgaagtgctgggattacaagcctaacctcttaatatcctcaccttaagagtcaaaattttaatgcatggattttggaagagaggtacacaaaactagagcatagcagacatattctagggttttactattacatcaggcaatctttctatcagaatcacttgaacatattctcttgatcaggtatacttgacacagaatttcataatgtaacctatgctaagatgtaggctttcaccttagtcttacttagaagaagataaggaggaaaacaagaaaggaggaaagaaatcctcaactacatttgtaaaagtttgggaatagtataatctatagtaatacacaggagaagtatgaagcgtatttgataaaactacatttttaaaatgtatgatgaataataattgtctataaatactgcaaatgggttagatgggtatcatgcctttgcttatctcagaaattcataccaatcacctaactgcttcaaacagttttctcaataagtgaggtattagtgtaaaaactaatagatatgatatttaattttatagaatttcttacaacttagtatgaatgcgattttcttgagcaaaatatatatgtgtgtgtatatatatatatacatatatatatctgtgaagtgaaacggagagaaaatattaaagctagttgaccataaaagttatcattttatgaagctagttcttagaacttgacagtgagaaaggaatttgtgaatgtgtctgatgaatctgacacagactattctaggtgctaaagactacatatggcatgatgtggagaggggggtaggaggaagagagatagagagacagaaagagagagagagaattccttgactacagtgaaatgacagatgtgggaattcacctagcaaataatgatctgttgaaaaatcagaatcccaaaatcgaattatagaaagcgtatctctaaatttcagagaagaaacagagcgtttcagtagtgatatgattcccagaaggataagaagtgaagactcaagtaaattaattggttcacatgttttataagttataatacatgaatgtcagcatacattattatctttaaagtttggtaatgtggaaaacaagtatctttaaaaagaataggagacataatgagatcgtatctctaccaaaaattaaaaaaaataaataaattagcttggcttggtggtacactcctatagtaccagctactcgggaggctgaggccagaggtttgcttgaacccaggagtttgaggctgcagtgagctctgatctcaccactgcactccagcctgggtgacagtgaaaccctatctctaaaccaccaccaccacaacaacagtagcaataaaagaatagggaaaattattttatgagttgaaataggattattaaaatagccctttgttattccaattcacctcattaatcataaactagcacaatcttattacaaaacaggtgtaattaaatacctttaaggaaatgtgtggagaagcatacaggcatcatcagaatacatttgactttcttaaagctattttttaaaaagagttattgcattatacttattttttcttttgtttatgatgtgatatatgaattttgaagttggcaaaataaaattaaattctgccattaaattggtaaggttttgtgtgtttcttagtcatactctattctacaagttcctgtattccccaaacaataagtagatttgaatagatttccatattctaattataccaataactaatgaattcagctattacttacgatgcattccaatcagaaatgtcactgatgtcaaacgcagtgtcagggaagtttctctggtatttgaaggtactgactactcacattaatcaaaataatcgacttatttataatgcaattggtttctgcttttgatgacattgtatttaataattatctttatggtttcacaaaatggctatttacaccccttaattaggaaaactatgtcagcatataaatacatatgcatatatgtatgtgtatattgtgtgtaatgtatgtataagtgccatgtaagaatgttaatggaagtatgattgctctaaaaattcagaatgaattggttcataagattaattgactaatgtttagaatgtgaataccatatttctaaaaatggtcttccagctaaatgggttctaccattaatttgtggaagatttcataacataatttaaaatttgtagtatcaatacaaacatatgctcataaataactgattagtgtttttcttaaaaatggaaaagtcagtatttttactgactgactttacataatggtaattttatatttatgcacttgaaaaatctcactgtgatattaacatatttacatctatgtaaagttgaggtcaaggaaattttcttgcatttatttccttacttgtaactattatatgacactaatcataattctctcctggcatgtgacctcagttatccaatagcagcattcctttgataggtatattaagataacacataaaaggtagggctgccattttactaataaaagtgtgatttttaaaaaataaaatagcgctttctagctccacacatcatgactgaaccagacactcatatttacctctatcacatatcataatagaattcttgagtcagtagaaattaagcagaaatgagtttaaatcacacagtgttgaagctgaaaagacatgaaatattacccatttcaacagttgtactttatacttgaggaaacaggctcacaggagagttatatgagtgtggtctagtatgcagaggaaattgaattaagagttagaagagctggtctgcagtcccttgctctgtcagtagtgcataaaatttaggaaattttcttaactattttgcaactgaagttttgcaactgaaacatgagcagaataaaaaagaataaagatttttcagtgtccgaaattacatcacgcaaaccctctgatcacattgagcacagaaacctcatctcagaacttttctgagaaatttaaataatttaagatacaaatacatccaaattaagtcccaaggatttactgcaaatggacatgacaaaattttgaaaagtgatgaaatatctaaaactggattgtagtagtggttgtataactgaataaatattctaaaaatcatcaggctgtacacttttaaaatgaataaatagttgaatttataggtatgtaaattatatctccataaatctcttttaaaaatctggtcacaaaaaaaccttgacaagtaaatttgacttaaaaaaaaatctgaacattctgactgaaaacaaaattttttaacaaagaagaaactgttcaacagattatctctcaaacagaagacaacactctgctggatagctttacaatactatcaatctaacttttaccttctattaatatttttctctaattgatcaagccaagtaaattcattttgagtcaacaaagacagtataatgacaatagagtttgctgttccttgtatctttgtgataagaaaaataattacaaaagagcaaatgtcattgtagtttgcgtatacaaatacaagacagcttctttgaatgtttgagttatgatgtgtgtgtttaagaatagagaatcacagattatttcagggtcatactgtagcaatgtaacatctaggactatcttcaagaatggcttttctagactattttggtgctttaattctattttaagcttccctactcagcttcattgttcatctggttgttaagcatgagcatttttttaatggaaagaaagcttgtctaaagggtaaattgccaaaaggattaaaagtgtgttcgttgcccagtcattttccaccctcagccccccgcctgctcccacctcatacacttatcatgctgtcactctttgctccagggcaatacgtttttatatacccacccaggcaggattccctgcctgatggacacggcttatagtggcctcaaaggaccagagatttgcgaagatgatcatctttcccattctttgaagagcagaaacagtaaaattgagtttcagggcattagccaatgagatgttaaaatatcaactaccatgcctcacctggcctgaaaccaaggttaagatcttctttagtgcttcctccccatctactcttcattcctgaaaatccaggctcccatctgccccttgcccagtgattttttttttctccataagctgatacatccttccattgggttatttactcccaaacccagcagaagatggagtcctaccactattggttctattactttctcttactcaggaatataattgatttgtgttgcgcaaagtaaagttggctttgattcaaacacatttttagaaaaattgtcccagtacacaggtttgtaacacttttatttttctcataccactccctcccagcctcactgagtttacatactcacatacatttaatactaaaacagataagctctgtaatcttcattttagtttttaattctgggacaccttaaacaagattttctagaattcaactattagatgatctctaaactattaatacattatcgtttgtaataagatactctgtactaactatatattttagcaaattttcttacattcttccatattatttatcattttgtgacgaaaatataataatctatcgattatgggatatagattctagtttgcttaagagagttcttgtataacttgtcttgttatacaagacatatttggatattcacttttactcttagaagtattccattctggtcaaaaactgatatagtcaccttagttatctgtcaccaattagatgtctctacaagtgaagtatagttgacacattacattacccttctccctttaagctgagtactgtatatttatgctgtaattaaatagttattattgactattacagattatgttttctgaaagttaaatttgaattcttaaaactcaaaatgtgtgggtatgcttgaaaaactaagcagtagatacaagaaatctaggaatttctgaacatagacttgccttttttgtagacaataaattgtattctttctttatcaccgcctaattaaagaacacagaataacttgccttcctgtttcagcagacacctaaagtaacacaaagaaaacacacatttacacacacattcttaataccaagtgatggtaatggcaatcacaaagaaaaaaaatggcttattggtcaaaatatctttctgaactaagagaaccaaactcatatgtgataagttgtatcaactgtttactacattgcattgcactgttttcctctatatactttctgatctcatttctgtggcatcatattccatagtctttattttcacgtctatattttttcttccaagctctttgttattctgttcatcttttaagcattaagtattcattatagcagagctctatatgcaagatccatctttagaaataccctttgtaaatgtaataaatatttactttatatttttgctcctcagtaaaaggagaatggcatttaattaattactggggtccttggattaggcaactcctctttttccctgacattgttaaaatttcatcaattattataataggttccttattgaactctacctctgctatatctccactttataaatccttgggttctactgttatatctgtgcactacttttaaatttgctctcatgctcaaaactctttggtagttctctgttgcccacaaagcacctagatgactggcttgggtgtctgctgttgctattcaccaactaagaaagaaaacaaggaaaaaataaaaccatttcctggaaggcagatggggaaaggaagaacatgaacttagttaaggtatgctgtcttgaagatgctgtagaaaacccagatcgaatttttcaacccttgcagtcctgaaataggatctgtgagacgttgatgagtgggcgttacagagaaaatgggagaaatcaacaaacagtagggatttaaagctgtgggactgaatgagatcattatagctccatcacattctatcttaatgctgatgagtctgtcttaatactaaaatataagctcttcgaggaaaagatttttttccccagaaactaaaatagatccaagaacaagtatctttcataattattgttttcattttaataaattatattagttattgtacatgggatataacgagtggttttcctttaacctagaaagaaaagcaccgaagatataactagtaaacgtctgattctattcttctttaaaagaagttagaaataagaatagtatgagcctttttaaacatgttttgggaaactggggtattatctgtaaaagtaaattacagttgcaccaaggtttttatctactctggacatttggcttgaggattatccttccatcctttcacgtgtgaaattgaaggtttccttttggttgtgtaagaaagttcaataccttagcatcacactctttaacagggcaatgaagctgtaatcctgccagtctcctttccgtatctaaatggttattagtttatcatgtgtttagttatccagggacgtacatgacaatctctttcttatgtctctacagttaataatacgtttaaaatcatatgtataatttatccatctgttctaaggcaagcattatgaattagaaggctgtagcacctcttaccactgcaaatactaactcactagaaaggaacattaaaatcaccagatgcttttgacatagtcaaaaccctttaatcctcaaatcttaagctcataagatatgagataaaagagatttttaaaaccattcagtccaagaagtaatgagacactagaattcctcttgatcattcagcaaggcattgcccatccttgcactgtggttctccccaggagacacctgggggagagaaacaggtaagtcccgacatcctacttcagccacagcaactccccctttttcataaacagaacttctaagtaagttttcacttaaacaagtagatctgaagattaattggagaaaattgttgaaaaccaatgcttaagtgaaaaacacttaaaccatattcaggtgatattcttccttataattctatggaattttttcttctggttctaccactgattttacttgactcaagaggccataaggaacagcagacttactctctcctcttgacagctttctgtttttccactttgaagtatttcaggagttgttgtcatgttccctataatcagatttcagcttattttcctcaggctcctcctttattcaactttaactagtacttatttttcttatggtacaggttatggaataaggagggggtgacttttatttggtggatttgcagtctagctgttctactgtgcttcttcccagttttttaaaatatgctttttaaaacttttttcagtactttatttccatacggtaaactaccccaatcttcacacagctctatgattttttgcacatatatataaacacttgtgaggccaccacacaaatcaagatgtagagcagttcagtccacccaactacttcatgtgtgcctttccagtcaatataactctccatggaatcgttattacgacttatattacctatacttatgcttcttatctatgagatcatacatttgtccctgtttgtctcacctttttagcttaacaaaatatttttaagtttgctcaaggttgttaaagcatagtacttaaaactgaacagaaagttcaaggtgaattctaaaacatccacaatgatgggttagcactttctttgctctgggtgggagttcaccctcaaatccttgcagtcatgtgacctgaatatgtgaaattatgcatttgtgaggaccatagatataagatattttggagtgatagggaccaaactagagagaaatttttatctcacccccaaaaagcattcaaggcaattcagaaaggaaagaaaaagaaatgtgataaatgattctatgcttcccttgaaaaaccagtcttcttgtcctattagccaacaatcttgcttagcttcctctcttccagattttgtgctgttaagaaatagtacagatatctcctcttttttagtaaccatattatactttccctaatgttgaaacataaggtcttaaaagaattcaatctctgaatagcatgtaataatccaggaagtcacacagacccttatctaaatttatccaggctttctattttccatatttcaggattagtggcatcttgtagtacctccttcttcctctgctgattgaccgtctgagtcccagaatttttattaaacacctctgttttccatctgctggtttcaagtgccattagatgtgataggcatgcaaatgacagaaagggtggcagagcacaccttgtttcccttcctcctccattgttaaaagaaccattttcactcctttcttcaagaggatattaatcaaaagccctcatatttgcaagttgtgttatcaatggattctcccactatttctactaattgtggtgttttttggccatgaagtcatttcttcctttcttgaaatattttagctgtgattcattgacagtgcttttgagaatgtatttgctacattttctggtaatttcaatatttacaataatcatctttataatacccttcaatgcagtggtctctcagtcccttgacctctgtcctccagatgactatgacttccactcaccttcaggcaatcatatggtcatgctttcagtatagatcttgtcattttctgtaactgcaaacctcatataacctcactttcattatccagctcctacttctcagcttatttcatgtagtactctgattccaataatacttggtcccactacaacctagaatccatcaattctaacatttttgcacagccccttatctccaatcatgtccccactcccatatttccttgtttaaattcttcaattcatcattatatattattgttttcatacatcctcaaccgttatgaccttccctcaattaatagtatatgcccttgacaaaactctagcatttgttaaatcttactttttgcttactctgtacctctgtcagtgcagttaaaagtgactagaaaaaaattcacaaccatgttgacaggtctcatttaaaatttatgatcagtaacctcaaatgagacattagtgttgcctggaattaggccaccactctttccttctcctttacctctacattataccttctcttttctcctcatacttctcgacttacccacacttacttttaggttataaccttgcttgataattctctgagaaaataaagggggctcagacaagaatttctgcatgttcccacatccatcccttacctacatctgcattcatctacttcttttctatgcctatgaatgaatatccgtccttctaactagggcaaagccttcctctttacctctcgaggacactacatttgcaaatctctcctctctctcattgttataaatatttccctccatactggatcatttctatcattatactaacatgcttttataattcctaattttaaaaaccttctcttgataacacttcatcctccagctacccatttctctctccccttcacacacacacacacacacacacacacacacacacacacttctcacattctttctgtttttctcaacttaccccaatcaggcttttgctccaatattccacaaagactgttcatgtcaagatcaccagtgaccccccacattattaaacatagtacctaattctcactcatgtcttatttgaactgtaagcagcatttgatacagattagtccaccatcctaggaacacgtttttcagttgacttcatacacacaaactctacttacattcgtcatgactcgctggttgttatgtcttactcttctttgctggttcttcttctccctaaggttttgctattgtcactctccaaggctcagttgttgatcatcttctcttttcatttatacttctttattggttctatctagttgatggcttgaaataccatgtaaactcaatgattccaaaatttttatgttcaaccctgaccattctcctaaacttcagaatgttttttcaattatctacacctccatctggatttctaatatttatacacatttaatatatccaaattcctgaatcccttgtccaaatcaatccaaatagtcgattttatttttagagaagttttaggtgcacatcaatattgaatggaaagtttagagatttcccgtataccctttgcccagttggtttcccccattatcaatgtttcccaacagagtggaacatttgctaaaattcacgaacctacattggcaaatcataatcacccgaagtccctagtttacattagggctcactcttggtgttgtatgttctatggcagaacactgacaacaccaaatgctggtaaggatgtggagcaacaggaactctcattcattgctagaggagtgcaaatggtacagccactttggaagacagtttagtggtctctttaaaaactacacatactcttagcatatgattcagctcttggtatttgcccaaaggagtagaaaacttacactcacacaagaatttgcagctgtgatagcagcttttttcataattacctaaccttggaaaaacccaagatgctcttcagtaggtaaatggataaactatggtacatccaaacaatggaatattattcggtgctaaaaagatatgaaatactgagccatgaaaagacatggaggaatctcagatacattttaccaagtaaaagaagccgatctggaaaggctacatactatatgattccagctatatgacataatggaaaaggcaaaactatggagatagtaaaaagatatatggttgctgagggttggggtattgggagggttgactaggcagaacacagaagatttttagggcagtgaaaatattctgcatgatactataatgatgggtatctgtcattatacatttacaacatcaagagtgaaccctaatgtaaactctagaaattgggtgactctgatgtgtcaacgtagattcatcagttaaaacgaatgtaccactctggtagaacatgttggtaatggaggaggctatgcatgtgtagaggcaggaggtatatgagaaatctctgtaccttccttctaactttgctgtaaatctaaaactgctttaaaaataaataaagtcttaaaaattgttatggatttctttcttactgattcataaaagcttttatatagaaattaggcctttttatgatataactataaaattttttatcaatttgtcttttactgttagcttattataattcattaagttttatctttttgtgtatttattaatgtatttaatagttgtagagtgttgagtcatatttagaaataacttcccattctaaggttcaaaaatatttccaaattttttctcatattttatgttttcttcattaaattaaacatctcttccaacctaatttgtttttatataaggtatgatgttagaattcaaatttgtttttgctccagctggctacacacataccaatgtcatttattcaactatccatctatttcactaaaggtactatcttcaatactacctttaccatatccaaatatacactcattgatatccaaacagtaatattgtccatcagtcagtgacatattattttcattgctatagttattattatttctgtaaatcaagaaatattggacagttaatctttattattcatagattccatgtttccagattcacctattctttaaaatttatctgtaatttcaatcaatactcaatgctttcgtggtcattcacagaattaagcatgcacagagcagtgacccagctgaggcccaacaagatgctgctctggttttttcagctctcatgccttaagtgttctttatgtggtttatttactaccacatttttgcatttttgtgctgtttgctgatgattttgctgtttaaaatggcctccaagcagagtgctaaaatgctgtcttatattcctaagcacaaagaaggctgtgctgggcttaatgagagaaaaatccgtgttttagataaatttcgttcaggcatgtgttagaatatgattgtccctaagtttaatgttggtgaatcaacaatacatacatccagaaaaagaaagaggaaattttctaatctgtacatgaaactaccccagcaagtgctacagtaacgtgtatggtgtatgagggagctagggaagacgtggaaatgtggctcaatttgtagtttcatgagataagaattgatttttttttaagtgtagttgatagtattgttgcaaagctgaaagccaaagaaatttccagtcacattatccagcatcagggaaatgatagacccttctctgctagtttttattacaacaaaatccatatataattagttatttataagaaatatatattaaataatgcatttttaaacacatatgaaacaaggttatgtgttcatcagttgatgaagatgttttgatcaaaaggtcgcaggatcctaaccttgtatttccccttggaacattgactcagtattcactgattcagtgttgacagcaactttgtaggtcacaactactatgtcccactctgagttttctcacttctctgttgcctttggaactgtctcattctcatatttaagttctgggatattgctggtgatcatctcgatcacctgtatatttgtttctcacttcttctggggggagtgaagccagcttgcttctgcagcaccatattgaaaccagaagtaagaacaatattaatgtgaaaagcaagaatcatttgtacttaaattttataaataatgctcaataagtatttagactatacttacggaaataatctgtatgttagataaatttttttacttttgtaattccttactcttataaaaaaaggatttcttagtcttgtagcctttaaactcaacaagaaaggacaacaagaaaattaaatgctctatcccatcagcttatgtcgtattccgctcatgccttgcttactctaaagtgagactatagtcagaaaatgagtccatccattcagttaccgatatatttcaaggcttttctgtaagttaagcactgcacttgttacttggaatgcaaatatcagtatgatgtgctatttgccattaagatctagcaaaaattgttatttcaattgatggcagggaatttcaaaataacatacgtatttttaatgagagaaaaaaataccaataacattaaagcaaatagagatgatatcacaaggaagctttgcaagctactgagttttctaatagtacaacatgactaaggggattttatctattggtgactttaaagttctaacttatttatttacctttaaaaaatattttggtctttttcattctgattgtaaagcgatattatgttcaacatggaaacttgtaaacattgacaaacatgaaggagagaaatcaccagtaatgatccatatacatatatatatatatatatatatatatatatatatatatatatttcttttttttttttttttgagacagagtttcactcttgtcccccaggctggagtgcagtggcacgatttcagctcactgcaacttccacctcctggtttcaagcgattcttctgcctcagcctcccaagtagatgggattacaggtatgccccactatgcccagctaattattgtatttttagtagagacgggtttttaccatgttggccaggctggtcttgatctcctgacctcaagtgatccacccacctcggcctcccaaagtgctgggattgcaggcgtgagccactgcgcccagctatgatccatatatattaacaattaagtagctaaacttatttagtacttaatacataaaaaatcctgttcttggctttcttgtattcattacaataccctaataaagtagtaatattatagcccctttttatatgtgagagatatgactgagaacacaggtgatatatgaaaaacaaggtttactatgaagtccaaacaatttttactttactacttatgtgatatcagtagcatcaaatgttttatgctatttttagtattgggggaaataatctggtaaaagctattaaaatttaaaaatatgtttatctttcaacacagaaaactgaaaacctatatatatgggatctttataaggacacttattccctccaaggaaaggtgtggcccggatgttgggaaactagataaggaccttgaactttacccagcaaatcctagagaacctttaggatgctttgaggtagtgaagtggcctagcataattgaattttagataaatcaccttggtggctatgtggtagcagattttagagggacaaaaccagttagaaggctgctttggtaatcgaggcaagagccagtaagagacaatcagtgagttcagacagtggtagtggagatggtgagagagagaaagagattagtctggagtatataaactgaaggttttaagactaacacactgaattggagtgcttgggcgtaatttgtgaaatgctagatgattgactgtttaggttatgacttctcagttcaaaccatcttttatgccttaagtgatctaacggtctacattctacaaagaaggcaaactaaggaaaacactgtttgttggccccaatgttgatgccagtctaaaaatgatgtatttattgtgctacttcgtgattcccttgtttccaactctttgctatcaataattatctaaggtaggcccgtgactgtggcccccaacatcctgtctagaaatttgaagaagggccaatgactttttgtaaattggttgtttgagagctggactgtctgttttgcagcatgtagtttgaagctataaaacatagatacttccatgcctcagaccttgttatttctaggaaagaaaaatgagaacagtacctttgattgtaatattttttcaaaagttgctgtgccatgatatgtctcgtaggtttcagaagacaaaccattatgaaaaaaatttgttgaaaaagcatgagaaagaagataataatatgataagctattccatagagttttccagtgagctagagaaattaggcagcaaaatacctcatccaatccttccacatcagcaaattgaatccttaatagcttctatgttcttaaatcctgaacacatttattaggagagttttagaatgaggaaaaaaaaactgaagtaaggacaccaattatccaccttcctaaccttcatccttggtcccaagccaggatattctcgatgtcctagagtctgaactcaaggtagatgtggctgagaatgcagccatgactgtaactctgtcattaagctatgaatttagggaaaagccaacaagttgattaagtcataaaacatcatcaaaattagcaagaggcaagccaaaaaagccccagcctataaccagggcactattcctcagagaactttttgtcccactagagacatgagaagttaggacctcctgctcactggtttcccccaccgcccactgaattatcagcatccgtagccacagctcattttaattcttgcatttatgataacgctatgtcattacaagaaggttcccatttccaaataatttaaatgatttatcttgcctggtgacttgaagtttatcaacttaaaattgaaataatagaagaaaaaactgcagatgagaacattttatcactttattattcaaaatagtacattctgaacctaaacatatttaactatctcatgttttgcgcttcccaaaaaagataagtaaaatatttttaaagaaaccattgataggcagatagacagacagacatacacgcacacatgcacacacaatcattagcataaaactgtctttgtagagacaaaattaattgaatagatgtaactgaaaagttggctttttattcttttatgagccttctatttggaagatcaacttattaagtaaatgcctttctttcctaaaacaattatggtagagagagttctttctcttcacctatgtaaaatgattattttttactgagagctaattatgtcagtttcttattctttccctagtgaattgtaaattatttgaatgtatgagtgtgttttctctcttcctcctttgttattcattgagaagatggtgaataaattttttgtcagaaaaggtataaaaatataaattaagaaaagagaagaagatggctaaatgcatgcttagtactattattctaatgccttcattaaaccagcagacacttgctgagtacctgtcctgtgccaatactgggatataaaatgaaacaagacgttatccctaccctcaagttcaatgtagaagacattaaataagtcaaaattttaatcaggtgtgatacatcctatcaaaataaaaacaaaagcagcaggtgtaataatataataaaatcctgaattctaatgtaccaaaaatttatccacatttaattatttgatatacataatctcactttatcttaatattatcccaaagaagtaggtattaccatcttaatttgataggaagataatagatataagaggcacctttatgacgatcacagagctttaaggtggcagaattagaatttgagtccagatctgtgtctccaaaactaagattctaaatagaaatctgtgctccttatgaataataatttttaaaaatacattgagattgcccttagaaatcagacaagaggcatttgaaactgactagaaagtcacagaatatattacagaggaggagatttgaactgacccattcatgaaggactactaggaattaactaggtgaaatgaaatggccacagtggggtggttttctaggcacagtttgcagcatatataaaagtttcatcataaagcccatgctaaatcttgcaagaaacaagtgttttttttctggcttactagaaggctttatatgacagagtgtgtaggaagctagaaatggagtcataggcctcatggacctcaccatatgatgaaaacgatagagcttcattgtcacaaaagtaaaaagtatttaaagctacatagtcttgctctctgaagtggagagcagcaacactcatagccttcatcatgtccccttgagagaaggataaatcccaagcccaggaagaacccctaaactttttgaagatgtctattgttttgcaactgtggatgatatactctgtgcaggtctgaatttctctgactcctggatggttaatatctccaatccacatgctattatttttctcaaaaatattgctttgtgtgaagtggcattttctaaatttactcattccacatatattcctacttgaggtcctggtaacccaaagattagtgggacatagttataaacttggaggatcttatagttttgtagaagagaagataggtgaagagatcatgacagcaaaatgccaaatgtgctgtaaatagcattataaaaatgaagctgtatgacaagtcaaataagcggttcaaagagcaggaaaagagtctccagaagaggccacatttgagacactatttcacagaaatgttctttctttcctccctgcctgcagtgccttcactttggcctctcagagttattgctttatgtatcagtctcccattatattctgccctcaaagactgagctgaatcaaatgtcactcttcctggctgtgtggctttgcaatttaaagggagatatatgcatttgtaagtctaattcaccttcacaagtagccactgcatttggcatcggttgtaggttcaaactttacatttccccatacttacagaaggggtgaaagagcagtatgtatagaagcttcatgtaggtatacctggcttaaagatagcagagaagaagcccatttattataacaaatatcttctaaaagcatactataaatgtaaatgatagttttatgaagtaaatggagatactaatgcatttacggccagtgtcaagagttcagtgaaaatggccctatacatcgtactgtcttgagttcagaaagtctcattataagtaatttcatagatatttctttataaagaccagggagcatatatactgcttaatgtgggtcagagcctacacttcatgtaaagtgcacacagtatttattaccaagactagggttttaaaaaaataagagctttagaagggaatgcatttcatttatattaaaggcaaacctagactaaggaataagttgtctcccaaaagttcaattgcaagtaagttattttgaaataagaacatattaacttaggagattattataaagggtggaaataaataatacccaatgtcaaggtaggatttaaaaattgagttgacttatttttttaatgtttctaaaacatgaatgatagaatattaactctagtcactgccttcttgctctagtcatatgcatggttatattttcctagggacaatcaggaatagagccagcgctactgattcttcaattcatgaagagatcattggtttagcatatatgtcaggagattctgttggttctgtgagatgctgtgagtgacaaagtccagaaaacatatttgttatatcaaacagcctagatcttacttctgtggtttattcataagcactttggaatagtgcttctcagcaatcattttaatgcttattttccttggagttttgtgtccatctttggaaatatctctaagatttctttagaagttgacccaggtgagacttctttagatagcactctggccttcaatgtctttattctgtcatcttttatcaatttacacaatgctgactgatttagaacattgacacatcagaagttactcatatttataaagcaggcttatttaaattcttaaaatcagaacaagaaaaaagttctgggaaaccaacatccacacagtctactgtcccctctattcgctatctggggaacgctaggaaaagtttagatattattgacaacgctttttagtcttctctagaaatagaattattttaaaactctgagaaatctagaatccatctgaactggaatgatttgtttggtcttggggagcagacaagaagttcataaccatgaaattatgcaggcccttctggaacctgcttaaaagtgggagtttttctgatgccttgattacctcaccaggggcagaaattgttaggagtgacaaccttataatcttattaacttaccaacactgggaaatcagatctcactttactaagtatattcactttcccttttaataagaaaataatctcatattttcctccttgaatctctagaacttagcccctcatccctcaactaattaactttaccttttatggagaatatggatacaagctgaaggaagccacactatcttctggccattgattccacaatctgaattgcactgggatccaaacatttgggcttcttttttacaatagtgaaaatagccttgcttttatccctccattggtcttcagatgttgccccttcttgtattgtggaagaagttccctagagcatttctcttctgcaaccagtacctcttaccttcctaccaggtcattccgtccatgtactaaacatgtcttagaccatctaattaaaagatatttaagtatccctccaagtaccaccattatgaaggtatagacctcaccttcaaggaaacattttcaaagaaaattcccagagttgttattacactttctaccttccattaaccctctccaagcaagttcccattctcaccaccccactgaaatacctccttccagactacctgtgatttatatcttgccaaagtcaatggccaattttctatccttaaaaaacttaaactttgaagctagttgactggttgagttttcctagatgccagaaatattttcttctccaggttccataaaaatccagtcttttgattttctgtctacaacactggccgttctttcttagtcttttttctgtacttctctcctatcaaacttctaaatagtgtgattcccaggaatttttttctattatcctttattctctatgtaagcttcctttctcatccctattaatgactttagatgctgtgcttacacagatgactcttgaactaatgtctttcacccagaatattctcccacatttcaggtttatacatccaactttctcatcagcatcttcctttggaagtccagtaggcaactccaacctagcatggccaagattaaattacttatttcagctgcctccccctgttgggtgctgtggctcacacctgtcatcccagcactttgggaggccgaggggttggatcacctgaggctgggagtatgagaccaacctgacgaacatggagaaaccctgtctctactgaaaatacaaaattagccaggtgtggtggtacacacctgtaatcccagctacttaggaggctgaggcaggagaattgcttgaacccgggaggcagaggttgcagtgagccaagatcacgtcgctgcactccagcctgggcaacaagagcgaaactccattaaaaaaaaaaaaaaacaaacaaacttcctccccctaaactgacttcttctgtcctaaatcttcttcattacattaaatggagctaccacccatccagtggattagatcaaatagttaagagtaatccttcatctcattcttttttccccactctatgtggtctatcaacaagccccttcatttgccatcatctccactaacatgatccttgcacaggctattgtcatctttcactgaactgctgtaacagcatcacaatttaattcctttcctctatttttgtcccttgcatttagttcaacgtacagaatccaagttatgtgtgtaaaagcatacaccagcatatgtcacctcctgcttaaaccttcaatggctttcagttgtaatcagatgaaatgattggccattgcctgtgagttccttgtgttcctcaccaacctcattccttttctctccatcatcacagaaggtgcctgccatactggcttcctttttgtcttttgaacaaacagagctaatacgtgcatcagagatttaacacttgcagattatctgccgggaacattctttggctgcttccatgttttggttcaagtctcaactcaaatgttttcttctcagagaagtctttcctacctgaaatagactccagtcattctctcatgttaacctattttatcttttacatgacacttattattattagtctctgtaattcctttctgtatttattcatttatgtacttactgtctgtctttgcctatgataatgtgtgctctggatgtcagggaatctgttcaccacagcattcccagtgcccagactctgttcagcacacagtatgcatcctgtgaaggttttttgtagattctagaaacaggtctctattctctattgacgatattaaatttgcaagcaagcataatttctggaagggaagattctcatggtaatttagccaacactgtatgttccattttgtgagtcatctagatattgtcttctgggagatgtacacagagcacatgcttcacatataataggcaaatttactaatcccatttgtttcctgtattttgaacgttaccaggagatatagtgaagaatttgactacgggtttcccagagcagtcactaattcaaacaaatgttcacatattaaattatttataatagttcttagctcttagagcaaaccacaaagacccatttaacctttatagttaagacctcaagtctcttaatgggcagaaagtgttacaaaatatgggcactaggaagagattctagaggttgatagaaagtggtaaggattagagtagtgaggaagaaaagaggttgggatctgacttcttcagcttatacagatgcaagatgggtcagtgatgcctatagtatttgtttgaagaagtggttatatatatagatatagatatccttattataaatattatatgccttgcaagaaaagtcatcagcaaacaatttaaaaacatgtatgtaagtgggccaggtgcagtggcgcatgcctgtaatcccagcactttgggaggccaaggctggagaattgcttgaggccaggagttcaagaccagcctgggaaacatggagagacccagtctctataaaaatgaaattaaaaaaattagctgtttatggtggtgtgcacctgtagtcctagctgctcgagaggctgaggcaaaaaggtcttctgagcccgggaagttgaggctgcaatgaactgtgattgtaccgctgcactccagcctgagtgacagagtaagactctgtctcaaaaataaataaataaaattttaaaagttaaatttgtttccaaaaaacccatgtaagcataatcttttgaattcagagtattccagaatgaaacctgcaaacgaaattgataaatgagtgatttcctgatataactgtccatgagtccacaaacgtaattgaaattcaatgctatagcaactacactaaacagaccatgggatggagtgttgaaaagtctttcattaagacagatgaatctatacttataaaagtgaacaaaaaaaagacacacacacatacacgtattttcactatttatttatatatataaaaataaataaatggtgaaggtgcaaaacaaaactaaaacagcagcgaaagaaaaaaaaaattagactgggctgccctacccctaacaagctatgtttccagagatacattactaacccctctggacctcagtgctctgtactctaagatgtaaagtctgtactatatgttttataagatctttattcaaaacagttgttctgtgttaccaaggagactctttggatgaatatcttttgtggataaaatctttctctattcttaggatactcagatgaagctgctcctatgagttttgaaaataggtgagaatatttctttaaataactgaaattgtgtcttaaatataataacaagctttgttttaaaaagtttacaacaaaactgattcatatcatgtacaaactaactactgacttgtaataattcctgatgtgttagtacaaatattttctgtaagaccttatatacgtaaattcataatctattgtattcactaagaagccaaaacattctggaagaaaaagaatattaagaaaagcattgacaggtaaatttttcccagaaattaaatgattatgtaatgctaagatgtgagggccaggtgcggtggctcacacctgtaatcccaaaacttcgggaggccgaagtgagtgtattacctgaggtcaggagctgagaccagcctggccaacatggtgaaaccacatctctactaaaaatacaaaactacctgggcgtggtggtacacacctgtagtcccagctactccggaggctgcggcagaagaatcgtttagaacccaggaggcggaggttgcagtgagctgagatcccgccattgcattccagcctgggtgacagcacaagactctgtctcagaaaaaaaaaaaaaagatgtgcaatgtgaagccattagcactatcaaatcactacatcctatgaatgctaatctgcctaatgaaggcaagtttttagttggggaacataaaattaccctaataagaagacagagaattttaaaaaggaatgcatggaaaaggtctgacttttcattttaaaaagtattatgcttgaaatgctgattattttagctataaatcatgcaactaactctctccttgaaaccattagggtttaaagctgatttacttagagttgctactaattacatgagttttaaatgacacatctgcagttgtattaagaggaaacaaaagcagaggcacatacaactctgatcaacaaggaatatttgcagtctacttaatcctttacctccttgcttaaatgcttttcaccatctgaaatttgtcatgagctgtacaaaaggtcatcattaaaatacgaaaagttcccagcatgtgaggaggaaagttacagaggatacactgggagttaaggacttaataaaatgttttatttttatttccttttctggcaaagatgctgaatgcatttatctgcttttttcttctaattcaacaggccactgcgacacccttaggagagaggcaaataagtccagagtactaaatgacagcaagaaacatgacatagactgttagttccatccctgaaaacatgccccattcgtaaaataaataagactgtacaacttacagaaatatagtaaacaatactatgaaggaattaatctactttaagaaatatttactgagaacatcctacaggcaagcatggtgctatgtcctccacaaattccagagcctgcccattgcacatttataatgtttcagtggaggaaaagataactgtaaaattttattcaaagcccaatggaatgaatcccataaaaaaaataataagaggcttcagggagtcagaaaaagatttactgtagcttgggaattaggaaaactgccctcatgtgttttcctctacatttgctcatgatctcccacctccatccttggtcctattccagtttactgataaaacataattgagtcaaaaaatatatcatcagcttcagtcccgttgataaagatggtctttcttctaaatctaaaatccacccaaatctggatacaatgcaatagcttctaggaccattatgtctctgtttctcaagttggtctatttaaaaaacaaagtgtcatttggatccccattccaagatgcatgaggtacatagatgttttgacagaggcctttgcatccttctgggctcttgccaaatccattctcagaaactgaatccatctcctgtacttgcagcccactgggcagaattctactagttatggaaagattagaaataattggtgcccaagtgtccaacatagaataaacttgtcactgctgtaccctgccactccactgtctcaactcctggtatcaacaactgtcaatcacaccagagctttagactctatattgtacatcaacctggatgctcaggttagttcctcagactagttcaaatagtctcctgtcctgtgtgtattcaggcttcccagtgtagctctccagccccattgctagctccaagtgacttcacaataagccaaatgaaaataggaaatccttttcatcatgcaggcatttttttttaaagattttttttcagtgcctggcaagatggccaaataggaacagctccagtctgcagctcccagcaagatcaatgcagaaggcaggtgatttctgcatttccagctgaggtacccagcccatctcactgggactggttaggcaaggggtccagcccatggagggtgagcagaagcagggtggggcatcacctcacccaggaagcgaaaggatttggggaactcccctagccaagggaagccatgagggactgtgctgtgaggaacagtgcactttggcccagctactacacttttctgatggtcttagcaacccgcagaccaggaggttccttgggtgcctacaccaccagggccctgggtttcaagcacaaaactgggcagccatttgggcagacaccaagctagctgcaggagtttttgtcatacctcagtggcgcctggaacaccagcgagacagaaccattcactcccctggaaagggggctgaagccatggagccaagtggtctagctcagcggatcccacccctatggagcccagcaagctaagatccactggcttgaaattcttgctgcgagcacagcagcctgaagtgacctgggacactcgagcttgggtcggggaaaggcgtccaccattactgaggcttgagtaggtggttttcccttcacagtgtaaacaaagccaccgggaagtttggactgtgtggagcccaccgcgtctcggcaaaaccactgtagccagacctcatctctagattcctcctctctgggcaggtcaagtctgaaagaaggcagcagccacagtcaggggcttattcccatctccctgggacagagcgcctaggggagggggcagctgtgcacgcagcttcagcagacttaaaagttcccgcctgatggctctgaagagaggaatagatctcccagcacagcgctcaagctctgctaagggacagactgcctcctcaagtgggtccctgaccccagtgcctcctgactgggagacacctcccagcaggggtcaacagacacctcatacaggagagctccagctggcatctgacggttacccctctgggacaaagctcccagaggaagaaacaggcagcaatctttgctgttctgcagcctctgctggtgatactcaggtaaacagggtctggagtggaccttcagcaaactccagcagacttgcagcagagggacctgactgtaagaaggaaaactaacaaacagaaaggaatagcatcaacatcaacaaaaaggacattcacacaaaaaaaccatccaaaggtcaccaacattaaaggccaaatgtagataaatccacaaagatgaggaaaaaacagtgcaaaaaggctgaaaattccaaaaaccagaacacctcttctcctccgaaggatcacaactccttgccaacaaggaaacaaaactggacagagaatgagtttgatgaattgacagaagtaggcttcagaaggtgggtaataacaaactcctccaagctaaaggagcatgttctaacccaatgcaaggaagctaaaaccttgaaaaaaagttacaaaaattgctgattagaataaccagtttagagaagaacataaatgacctgatggagctgaaaaacacagcacaagaactttgtgaagcattcacaagtatcaatagccaaatcgatcaagcagaagaaaggatatcagagattgaagatcagctcaatgaaataaagcgtgaagacaagattagagaaaaaataatgaaaacgaacaaacaaagcctccaagaaatatgggactatgtgaaaaaaacaaacctatgtttgattggtgtacctgaaagtgacggggagaatggaaccaagttggaaaacactcttcaggatattatccaggagaacttccccaacttagcaaggcaggccaacattcaaattcaggaaatacagagaacaccacaaagatattccctgagaagagcaaccccaaaacacataattgtcagattcaccaaggttgaaatgaaggaaaaaatattaagggcagccagagagaaaggtcaggttacccacaaagggaagcccattagactaacagaggatctctctgcaaaaaccctacaagccagaagagagtgggggccaatattcaacattcttaaagagaagaattttcaacccagaatttcatatccagccaaactaagcttcataagcaaaggagaaataaaatcctttacaggcaagcaaatgctgagagattttgtcaccaccaggcctgccttacaagagctcctgaaggaagcactaaatatggaaaaaaaaaaacccaaaaaaacagtaccagccactgcaaaaacataccaaattgtaaagaccattgacaccatgaagaaactgcatcaactaacgggcaaaataaccaactagcatcataatgacaggatcaaattcacacataacaatattaaccttaaatataaatgggctaaatgccccagttaaaagacacagactggaaaattgtataaaatgtcaagacccatcagtgtgctgtattcaggaggcctatctcacgtgcaaagacatacgtaggctcaaaataaagggatggaggaatatttaccaagcaaatggaaagcaaaaacaagcagggattgcaatcctagcctctgataaaacagactttaaaccaacaaagatcaaaagagacaagggcattatatcattgtaaagggatcaatgcaacaagaagagctaactatcctaaatatatatgcacccaatacaggagcacccagattcataaagcaagttattagagtgatacaaagtgacttagattcccacacaataataatgggagactttttaacaccccactgtcaatattagacgtatcaacgagacagaaaattaacaaggatattcaggacttgaacgcagctctggactaagcagatctaacagacatctacagaactctccaccccaaatcaacagaatatacattcttctcagcatcacatcgcacttattctaacattgaccacataattggaagtaaaacactcctcagcaagtacaaaagaatggaaatcataacaatcataacaaacagtctctcagaccacagtgcaatcaaattagaactcaggattaagaaactcactcaaaaccacacaaccacatggaaactgaacaacgtgctcctgaatgactactgggtaaataacgaaattaaggcagaaataaaggttttctttgaaaccaatgagaacaaagacataacgtaccagaatctctgggacacatttaaagcagtgtgtagaaggaaatttataaaactaaatgcccacaggagaaaccaggaaagatctaaaattgacatttcaacatcacaattaaaactactagagaaacaagagcaaacaaattcaaaaccaagcagaagacaagaaataactaagatcagagcagaactgaaacagatagagatatgaaaaaccctgcaaaaactcagtgaattcaggagctggtttttttgaaaagatcaacaaaatagatagactgctagccaggctaataaagaaggtaagagagatgaatcaaatagaggcaataaaaatgataaaggggatatcaccactgatcccacagaaatacaaactaccatcagagaatactatgaacacctctatgcaaataaactagaaaatctagaggaattggataaattcctggacacatacaccctcccaggactaaaccaagatgaagccaaatccttgaatagacaagttctgaaattgaggcagtaattaatagcctaccaactaataaaagcccaggaccagacagattcacagctgaattctaccagaggtgcaaagaggagctggtgccattccttctgaaactattccaaacaacagaaaaagagggaatcctccctaactcattttatgaggccagaatcatccttataccaaaacctagcagagacacaacaaaaaagaaaatttcaggccaatatcctcgatgaatatcgatgtgaaaatcctcaataaaatactggcaaactaaattcagcagcacatcaaaaagcttatccaccaggattaagtcggcttcatccctgggatgcaaggctggttcaacatacggaaatcaataaatgtaatccatcacataaacagaaccaatgacaaaaaccacatgattatctcaatagatgcagaaaaggccttcgataaaattcaacaccccttcatgctaaaaactctcaataaactaaccagtgttggaatgtatctcaaaataataagagctatttatgacaaatccacagccaatatcatactgaacgggcaaaagctggaagcattccctttgaaaaccagcacaagacaaggttgccctctctcaccactcctattcaacatagtattggatgttctggccagggcaatcaaacaagagaaagaaataaagcgtattcaaataggaagagaggaagtcaaattgcctctgtatgcagatgacatgattgtatatttagaaaaccccattgtctcagcccaaaatcttcttaagctgataagcaacttcagcaaagtctcaggatacaaaattaatgtgcaaaaatcacaagcattctatacatcaatgatagacaaacagagagtcaaatcatgagtgaactcccattcacaattgctacaaagagaataaaatacctaggaatacaacttacaagggatatgaaggacctcttcagggagaactacaaaccactgctcaaggaaataagagaggactcaaacaaatggaaaacattccatgctcatgggtaggaagaatcaacgttgtcaaaatggccatactgcccaatgtaatttatagattcagtgttatccccatcaagctaccattgactttcttcacagaattaggaaaaaaactactttaaatttcatatgagaccaaaaaagagcccatgtagccaagacaatcttaagcaaaaagaacaaagctggaggcatcacgctacctgacttcaaaccatactacaagtctatagtaacaaaaacagcatggcactggtaccaaaacagatatatagaccaatggaacggaacagatcagaggcctcagaaataatgccacacatctacaaccatctgatctttgacaaacctgacaaaaacaagcaatgggttaaggattccctattttataaatgatgttgggaaaactggctagacatatgcagaagagtgaaactgaaccccttctttgtatcttatgcaaaaattaactcaagatggattaaagacttaaatgtaagacctaaaaccatgaaaacccttgaagaaaacctaggcaataccatttaggacatagtcatgggcaaagacttcatgactaaaacaccaaaagcaatggcaaaaaaagccaaaattgacaaatgggacctaattaaactaaagagcttctgcacaacaaaagaaatgatcatcagagtgaatagacaacctacagaatgggagaaaatttttgcaacctatccatctgacaaagggctaatatccagaatctacaaggaacttaaacaaatttaaaagaaaaagacaaccccatcaaaaagtgggcaaaggatatgaacagacacttctcaaaagaagacatttatgcagccaacaaacatatgacaaaaagcttatcatcactggtcattagagacatgcaaatcaaaaccacagtgagataccatctcatgccagttagaatggcaatcattaaaaagtcaagaaacaacagatgctggagagcatgtggagaaataggagtgcttttacacagttggtaggaatgtaaattagttcaactattgtggaagacagtgtgacaattcctcaaggatctagaaccagaaataccatttgatccagcaatcccattactgggtatatacccaaaggattattaatcattctactataaagatacgtacacgtgtatgtttatttcagcactattcacaatagcaaaagcttggaaccaacccaaatgcccatcaatgatagattggataaaaaaaatgtggcccatatataccatggaatactatgcagccataaaaaatgatgagttcatgtcctttggagggacatggttgaagctggaaaccatcattctcagcaaactaacacaggaacaggaacccaaacaccacatgttatcacttataaatgggagttgaacaatgagaacacatggacacagggagggaaagatcacacactgggacctgttggggggtggggctaggggagggatagcattagtagaaaaacctaatgtaggtgacgggttgatgagtgcagcgaaccaccatggcatgtgtgtacctatgtaacaaacctgcatgttcttcacatgtatcccagaacttaaagtataagaaataaaagattttttttctcataagggaagataaattttatagctaaaataaaatgcaaaatgtgcagctcaggcaggtgaaatgtctggttggaccacagaacttactaattactcttatcttttaggcatctgagttttctactgcttcttgttgtagacactgctcctctcgccacttttattgcaggggaacagtgtttcactctggcccaaaaaaggataaatatcccttcctttgattctttttgcatgactaagaggagctagaattttcctattgctttactaaattgtaaaagagaataaatgaatactacataaagtatattcagttgaatgtttttgcttataaggtcagagttactacttagcttgcttttgggcactcttgggcactattcaaagatcaaagagtggaactatagatctgtgatggttaattttgtatttcaacttcactgggctatgggatgcccagatagccagtaaaacattatttatcaatgtgtctgtgaaggtgtttttggaagagatcagcatttgaattggagaactgagtaaagcagatgaccctgcccaatgtgactgggcagcatccaatatgttaagggactaaatagaaaaaaaaggcagaggaagggtgaatttgctctctctccttgacctgagacatccatcttctcttgtgtttggatattggtgctcctggttctaatgctttcaggctcagaggaggacttacaccatcagcacctcaccctcattttcaggccttcagactcaacctaaattacaccactagttttcataattctccagcttgcagacagcagatattgggactttttggcctccatatccatgtgagctaattccctgttatctatatctatacctatatatccatctctttattctgttctgctggttttgtttctgtaggtaatcctgactaatagaagcaccaaaagactagtattatttacagctgccttgtgtgggtcttaagatataaaaagtgtgcttacctatagagacaggatgttatgcatgaggcctggcccaggtagctaagtaaaacaaaatcaaaaacagatagcttcttctctgatgtgttttccaatcttaggaatcttagtgatccgctaacctacagtgtcactttcagtaaacttttcgctccttagggagtgtgcctgccaaatgattttatctatacagctccatcagtataactgcttatttaaaacaacataatatttaatatgccatgcaatccctggattgcaagtttcaagagtactggattatatatttttcactaatatattactaaagctttgcacaatacatggaaaacagatgtgtcaagaaatatgtgttgcccaattgaataaattggaattgcgtctataagatgaagggaagaggagaaggaaaagttgcatacttcctttcagccttagacagcaggtaggatttcagaagacagaaatttagggtgaggatactccaaacaagcaccttaaacaagacaatccagaaaagtgtgaggaccataatgaaatgtgttgtaaagagtgagtaattctgtctgtgtcatatccacaaaatacaaggactgcctaaacacaccaattttgttacagttcctttttagatcattataagatatctaaaacctgatttggttaccatcagtttattttcctcatggtttgctttgtaacttgtatgcaggaagataaataatgagagctgtttcaaaaaacacaagagcttagaaggattgtaactgcagttattgattgaagtggaaaaataaatataaaatatatcatcttgctatttctagagcaggaaggaaaaaaataatatcaaatgagggagaaagcaaacctctttctccctcatagggagcataggatgacactaaaaaaatcaacattctcagaaaatgagagacagaaaaaaaaaaaaagaacacttaagtaaaacctgaaggaagactagtagtcagacttttggatgtgtcaggattactcataattataatgcctatatcggtatgtagccagaaaaagtgaaatacgcttagaatacaagcaagaaattgaccgtgctttgtaaatgcgtgtttctatttcattcatctcttcatgtattcacctgctctatgccatgcactgtactagattacagggatgcgacagaaagatgcagtaactaggctcctggagtccttcaccgaattagagagatacatacaaaataaataattgtatcattaactaattaataacaatgtgatgagggatatgaaggagaattccaggggactaagggaatatttaactggaagaccctaatttagtcaatgaaattagaaaaggcttttctgaaaaagtacccttttcatatgcaagcaatctgtggatgattatttcatacttgcatgattttctattgataaatgcccccacaatattttgttttacctttaaatagtatatattattagttttcaaccattgtctgtttgcccgtatagctaacacttatgaataatagttactttctacggataaggaacctggataaggatatggacaaggaattctggatcttatttcatcttattcttttctgtccaggttgagtgatgctctttgtttgtctttttcttttctttttccttttatggcattttttatatgagacagggtcttgctacattggctgggttggtcttgaattcctggcctcaagcaatcctcccaccttggtctcccaaagcgttaggattacaggtgcaagccactgcacctggccctttgtttttctttgtcttgccaggtttagacaatacaataaatagtagaaaaattatgacttgcagaacaggggtaataataatagtaataataatgatgatgatgactaatattgagaatttattatgcaccaggcactgttctaaatattttgtgaacattaagtacttcctattgataaagacctagaaattttaatatggtcataattcaagccgaatgaggccaggcatggtgtctcatgcctgtaatcccagcattttgggaggctgaggcaggtgggtcacctgaggtcaggagttcaagaccagcctggccaacatggtgaaaccttgtctctactaaaaatacaaaattagccgagtgtggtggcgcatgcctgtagtctcagctactcaggaggctgaggcaagagaatctctggaacccaagaggcagaggctgcagtgagccgagatcgcaccactgcactccagcctgggtgagacagagtgagactctgtctcaaaaataataataataataataataatttcaagctgaatgaaatttctttaagttatattaaagcaaatcaaagcacaattctatgtacactttaagctggagaaattaattccaactatcttttatatacaaaaaatctctgatatataggttttaatataataatttcagattatttttctgaatcctgtcataaaattttacatttataaaactcaatgtgtgttcttcaacacttagcacagcaatgaacccaaggaggcatagacttggaataaatatttttaagtgaaacatcgtaatgaaaaaaacaatactgatttttatttcctcggctgaggttctttggcttgaacatgattaatgcaatctttgacatcttttactttgttatctagggttcagcatgctgacaatatttccagtggtgcatgggtctttcaatatctccatttgatggtctgctatatttaagaaactagtactggcagcgcgcggtggctcacgcctgtaatcccagcacttggggaggccgaggcaggtggatcacgaggtcaggagatccagaccatcctggctaacacggtgaaaccccatctctactaaaaataccaaatattagccgggcatggtggtgagcgtctgtagtcccagctactcgggaggctgaggcaggaggatggtgtgaacctgggaggcggagcttgcagtgaacagagatagagccactgcactccagcttgggcgacagagcgagaatccgtctcaaaaaaagaaaaaaaaagaaaaagaaaaagaaactagtacttggtatttcattaattgtgagattttttaaaaatttatgtttttatacttgatgccctttactaattaaatgaggtaggaatcctggcatgaatatgaagaaacaaaaatagcaaactccaaacatgccacccaactacctaacatatatttctgatcaaaacttaggattccatatgcaaataatcttacatacctggtctttgttatataaatgttctgtcctgagtttgagaagatcataacaagtagtctgtcaaacaacccagggtaataatacaagtttttctgaatcatatccacaccttttataaaaaatgtccagcagttgcatttagaaatatgtaataatttttactaagatgttgcaacatgctttatggcttttcttcaaaattatatttcctaatattgtacagattggtttcccatcctaaaagtcagtttttttaaaaaactgtcccaaattttcgagtgtcttcatttcttaaaatgtttttgtaacaaatactaaaatcattgagtgtgttttcaacaaaatgagattatgtcataaaatgcgtctttaataacttttagtaacattttgaaggaacgatgaaatgattacttttcctttagtagcttcagtgactgtctagcaaaatctcacaagatggcaagaattaatccaaagctgaacaaagctaagacatcacttcctaaaaagcgtttcttttacataaataaaatataaattaacttaaaatttatttttgaaaatgtacaaaagtaatgtgatagttgaatttcaaaaacaaggtcctatgaacttccacttgtaattttaaaatagcagctacattagaggtaaagttttaatttctggaaaagtaatacctaacgaaaagaataaatttttttatttatttttcattttcttagtcttgtatctcaagatttgcagctaggctggagttgacaagtacagcgcactcttaattaaagttacattgaagacaaagattagaaataaaagtagatgctttgtgaaaagcattggcctttggtttcccttttacacttttcttagaagtaaaaaacacgctattaatagagaagtctgtactcataaatgtcactgatccatcagttggtacatttgaagaaaaataaaacttctttcacctaacagcagctcagattggaccatgaactgctgtcaaatgttcacaaagccaggaggaaatataaataggattatctcaggtaattttcttttaaaaattgcctgtgagactttagataactagtgtcttatactgcaaatttattatcttgtttcttttctttttctcatctcagtatgcttatagacctcctctgaaaggtttcgaatcttacgagatttgcatttacatttcactttgctgcacagtgcacaagtgttccttagtaacgctgcaactgattttagcttagaaacttccaccttgtattattaactgtctgggaggatgcccagaatttaactggactactctaagtcactaacatgccttattaatcaatacatcaactcttagggcatagaaactcaaagcagtacactagaatgaaaaagattatttgtaagctaactagaagaaaactttagcaatataaaagagaaaaggccgtgataattaaaaccagcacaattcaggctacagttggaatgaatctattcctacatagatgtatacaaattgttctaaaaccactagcatgattgaatcaattagctactgcataaaagcctcaacaattagttgtttaaaacaccaccatttgtttagcacatgattcagctactcagtaaatttcgtagggttcagagaatagttctggcatcatttgggctaccctatgcaactgcgagtctcctgagagattatttctgcagcttgactggctgatggttggggtcccttggccctcccatatcatggagtcgctcatcctccagcaggctcggtttgtcacatggcagtgtcaaggttcacagggagagggggaaagagagtatgtctggtatcttgaggtatcttcctggtactggcacactgtcaattataccacttcctattggccaaagcatgtcataagactagcccacatttaagaggtggggaaagaaactttacccctttctgtatttatggcatttaaaataagaatttggaaagaaaaattgaagccatccttgcaatcagcttattgaaatattttactttctgaacatttgttgagagataaaagcattttacattttctttctttctttctttctttctttctttctttctttctttctttctttctttctttccttctttccttcttttcttttctttcttttttttttttttttacttgaggcaggatcttgctctgccacccaggctgagtacagtggtgtgatcatagctcactacagcctggaactcctgggctcaggtgatcctcctacttcagcctctgagtagctgggactataggcatacaccaccacaccctgctatttatctactttttgtagagataaagtcttgagatgttacccaggctgttctcaaactcctagccttaagcaatcctccgcccttggcctcccaaagttctgggattacaggcatgagccactgtactcagcctacatttcccaatactgtgatttaaaataagctgttgaattccaccttactatgacaattttattgaatcattttttaaaaactatctatgaaatccccatcccaacttctgtttctttccataatgctaggatttctgagtaatttaaaatgcagagacatctgatggagctatattttgcttaagactattagaaatatatggtttggaagaataattccaattagtctttttcaaacatttactatatgactgttattgttatataatctattgggtacaaatgaaatgaaagtaaattgtccttcctgtaaggggattatattcattttgaagatgcaaggttatatatataattattagtcaaataagaaatgttagaaactatttgatctatttatatattttatagaaatgtctcctcctataatagtcctactgtttatgacacaacttgagaacactgtaatgcccaataaggtggtaggttgtaagtcaagcaagaaatacaaaaggaattagaattaggagagagacatcgaagcaagtattttcagggaagattacattgagcgggtgggacttaaatgggccttgaatggtcttggtatttgtgcaaatattaaattagcatctccctattctgagcccacccttctacactcttctctaacatattagagttacaactctacaaacctattcttccttttcagctggcttcgtgttaggctctgccaacagggagcattagagggagactaaaaagcttaagaaattattattactatttttatgagacttaatcctaagaatggcaaggattcattggttggcatttgttctgcaaatgaggactcttcacccatgaccctctcctgacagagcatgggacccacctggagatgagttgagccaagtctatggaaggaaagtctggggacaaagaacaggaatggtcatgagaagattaaagggtatggttacacaattggactcattgaaacagaaggtctctattgggaaatgatggaaaatatgcatggatatagaggtagattatcttggaaagtcaggcagaatcgctgccttaacaaacataaccacagtgttacagtaaagaaatgttggggctaggtgcggtccctcatgtctgaaaccccagcactctgagagatcaaagtgggagaatcacttgaggtcaggaggtgtagaccagcctgggcaacatagtgagacctcatctctacaaaaaataaaaaaaaaaaatagccagtcatgatggtgcacacacttccaaactatcaaagcagtgtcagctactttggaggttgaggcaggagaaacacttgagcccaggatttggaggctgcagtgagctatgattgtgccactgcactccagtgcactctggtcagcagagcaagaccttatccctgaaaaaataagataaaagaaatgttggaaacttcagtttctatgtgctcttatttaatattatcctaaggaagtcagcattcctattttaaaggacacactgaatattattggtggatctataatgtttgcttaaattgcttttcacgttattttatttatttaaaaaataattttcttaaggaaaactaatttgatcctgattttacattgtacagcagtgatatgaataaatggtagattgaagatcacaaatgacctaggcagccagtagtgaacgagaagagctggatttactactattgttagacttttcaaggctcaccttgaagaaatgtagcacagctgcaaaaagctggaaaatgatgtatatttttcagaaatggcagacaataatgaggacaagtgagactgccctatttaaagaactgtaaagttgtacacggcatggactgatccaggtgtagcacaatgctaggcacagaaagagaatagctaacatgtattaaacagtccctaagcaccaggcaatatgttaagtatattgtatggtctatttgatttaatccttgtaaccctatgagagagatggtatcattgtcctcacatcacagaagctggaaaagaggctttgaaatttagtaatatctatattcaaaaccaactggactccaaaggtcacacttaactagtgcatttacctagaaaaaacttaattaataggtagtgaataattaactgaattaatctgtgcagaaagagtaatcttgctcttcaccatcataatgtgtattttataccatctgccatagatattgaacataccatcagcacaattctactcaaaaacaaacagaaaacataatgcttataataaaaaggacttccaaaatcaaccgaaggcctgaaacctggtaagcacagtctataagaagtgccagtatattgtcttaattttcaataagtagcacagcgcaaaggtattgcaagccatatggattttgacaaccgtgctttaataactttggaaaagccttactacttgttaaaaaaaggaaaaaaaggttttagttggcttcttacaattaaccaccctaaaggacttttctcccaaaacggaacagttgattccacaattcatgcaatctaaaaatcaaagtatctctatacatgagatatataaccttcatacacgtattcgtgtgcatgggcctgcacacacacatacacaacacacacagactcagaatgttggagctaagaaggtcccctgggatcctcaagtccatccccccaacacccaggtttgcgtatttcacccagttcatagctcaaggctgatattcagatggtctgcaccagtttgtacgtaccagttaataaaatgagaaaatgattcagaggcagctggtaaacaactatagtcatttcctctagtctcccagggtcttaactccacctctgcaattaagttttcctgattcctaccctgaaacacctagggaccttttcctgatctagcaaccaaagagtgaacccatggggcagcaggaagcctcctcaatgttcctgcatgcaggttgatcaatatttttaatgtcaacgctaagaactgactagaatccagagcttcagtcccaattccagagttctatcttgtctaaccacctgcctttcttaagtgttagtattttattgcaatcaaatgaatttctttatttttactgcaaaacactagtcctagatatttaaaggtaacctttccctttccattcaaacttaattccttttgttttgtttatgttttaccattttctccaactcattgtgcagtttattgatgccactgtgaatccaatcacattactgttctctttcaatgctttttttctcttctgtatttagccaaatttttttagctattgccctttcttctttttttatgacacatttttacccaacaaatatgtagtgatctaggaatgatctagctgaatgtcttgcatgtctaaaccatttttccttttctgtatattatttcaaatattcattgaaactgtaaaaattaactaacagtgaatcaataagaattgacttgatatataatgataaagttttgtgtacagggcttaggctcttagaattttttgcacagcgcttagaaagtaagagctcactatttattatgttacacatttgagtgaattcatgcagcttccaaaaatgatgagagctgactaaatttcagttggctcacttaattttcacatcactcatttacttagccaacaattcagtttttttctttttcttctctctaatatccaacaatgtaacagtcatacttcctgggaaatgttcagataaggataaagaaattcagggctggtccctctaactacctgcttattttaatctgctatagtacaacatctccatgctatatatgctattgcaaattcatagaagttttagaaaaggaagggaaacctctaaagtctcataatcaatgtttccctttattgagtcactattacataccaggcataggtctaagagttgcatgggtcactcaatgttctgtacatattttctagtttgattctcatgctagccctttgggatgtgaattattattatctccattttgcagaaggcatgaagaagttcaataattgttctgtatccacactgaaagcaatggagatattttgactcctgaatctgaaccctttagttagtacattgtacatctaatacttgccaaaaccttgtgaaacaggtagtgtatcaaatttttatggaagaggaaactgagctcatatgattttatgggtttaagtgtgtccttaaacatacaaatgtatgtttaagttttaaccacccccaacccatacccctgaatgtgaccttatttggaaacagggtcattgcagctgtaattcgttaggataaggtcatactggagtagatatgggcccttattcccatataaggcccatttaaaaggtaaatttggacacaggaaggaagagaagactatgcgaagactcagacacagagggaaggtggccacatgaagacagagacagaaattaaaattatgctgacacaaaccaaagaatgcctggggctaccagaggctggaaaaggcaagaaagaatcctctgctagagtcttggcagaagtagcatgccatgtcatgcactcctggcccgtagaactgtaaaagaataagttttttgttgctttaagccccccattttatggtactttgttactgcagccctcagaaaggaggagagtgtttagcgtttttgctaaaggccatgatttagtaagtggcaggtacaaaattattgatgtggatgaataaattcaattcttgatatatctgaattttccaaagacatggaattaagcattttctaaatgcctgataattgcttcctgtacttgtcctcagcctttccccactacacctaacaacttctgcatcatttgtcccacaaataaactatgtgtgctaccattgaaggccaatctacgcactatcccaggccatcttgcctactcaagactccaatatttctccccttctccttctacatcatttgcctactctctattggctcactcagcatataaggctgctgttattttttctcatttttaaaatcaacaaacacacacactgcttttgactccactgcttgtatcagctactgccccatcccttcgttgttttgcagcaaaatggtgcaaaagagttatgtatcatatacactgttttggattcttctgccattttaccttaaaaccactttggtatcactccactgaaacttccctagggaggacaacaatgacctccatgtcactcaagccagtgatcacttctggttgcttatctaagttgactaattgtcacggtgatgacacatatatacaaaatgtttcacctgaagttcaagatagactttctttacaaggcttccaaaatatcaaagtgtgttttcctcctatgtctgtagttgcttcttggcctcttttgctactctttcctcttctttacctcttcaggttgaaaagcctcaggacttaaatatcagtgcttttcaccactttgtctaaactgctcccttcctgagttaatctgtatgcctctgactcccaaattgatatctcaaattgatatctccattctcaaatcctccgctagacttcagattaatacaaatgcaccactgttttcttcgagtctatgttcaacacagtagccagagtgatccttttaaaacctaaaagctggatcatgccactgctctgcacagagctctgcaatgtgttccatctttaacatctttgaaatggcctacacatccctccattctctgagcttttctaccagtttttcccccatccttcatttactctgatcctgcacacaagcctactcgttgttccttggatgagtccttcatactcccaacgcagagcagccctcaggctctttcctaagcctagagtgctcttttctcagatatttgcttggctaattccaattctcacacacccatcacaactccactcagacctcaccgactctgtgagtctttctctggacatcctactgaacattgcaagctgccggccccaccctgtctccaccctagcacccctgcccctgatttcctgattcatgcttcctttttgccataataatttaatctactatacaatttaattatttattaagttctaatttttatactgtcttcctatggtagaatgtaagctctccaagggcaatgttcccaaactgttttgcccattggtatcccagaggatgcccagagcctggcatatactaactgtacagaaaacatttgttgaatgacagaactataatcagtgataacttaatcactatacattggcactgtggtaagatgcttctttttggttcatatataagagtgaagaatcttctaagaaatattggcatttccagagcttatacttgcctactttcttatatcacttagatgaaaataattattggaaaaggaatataatatttatagatttttaataaatagttcttgttttatattattctcttgattctcttggaatgaatgaaagtttttctcttgggtcatttttctgtgatccagtaaaaaataaaagacagctgttctatttttgcactgtattccttactgcagttcatagcacaatcaatactgatttacattaatgcaaaacttattgcctctaccaaataagcttccaaaagggtcttctgaataaattgaaaaaatggtgctaaaagttcagcaaatctcaaatcataattggatagctgtgccctcagctggtaaaaaattgtatgaggtgctgagtgtaattttatttattgatttccttcgttctagagttggtgaagggcaataaaaggaatagttaaatcaaaatgttgaaatgttgtgatttattaatagaaagaatgtgtcacatctctctgcacacctacaaaattgcttattttgtccttaatgtattttcagacagtgtttttatttgggaaaccaaaatgaccaccaggtcacttttcaataatgtctttcttctttgaatctctcagtaagaaaagtttcatttactttatgtgttatgattcatggtaaattatttatgatacgatcaggtaattggaagtatctcatgattccctccaatctttattttcatagattttaatttttcaggtagaacaattcagtcatggacaaggttggcagaaaaaaaaaaaagcattccaatttgagtggacaggtgcagtattagacatccaaaaaggcatttaggcaggtgtttttccaagtggttataaactatggtatgtacaatttactttttcggcattttcaatttggagacagaaatatatttatatgtttttcttagtaactttgtttcatgggaattttcttgaattcatataatcctagatttaaaaattcatatcctataagggatctgaattaatagatgtttagaaatctagagaatttagagaagtttagaatacagtcagccattagtgaaatgtagagcatgatcagcctttagtgaaaatcaaagtgaaatctccagataacgaaatcatgtcatacttctatccagggatccatccagataagttttagtttaaggcctctgaataatgtgtccaatcaaccctcaggcttattctatgaaaagtgtgttttataataaaatattcctttatgctaatttgccttttgcagcatttacttgcatctggatgccataataatttttttagtgaattaaagatataactgcaatactataagtgatggcagcagctcctcaagcaccagtagttccttagactgcacctatctgatatccagtcgaattggagcttcaacacaatgtaaactgtcttggtccattccagatgctaaaacaaaatatcataaactgggtaacttatgaacaaaataaatgtattttcacacttctggaggctgtgaatgggaagtcccagatcaagacacttcctcgttcatagaaatggcaccctctcgctgtgttctaacatggcagaaggagcaaggcagtttcctgaggcctcttttgcaaaggcactaattgcattcatgtggtgttcacccttatgccccagtcacctctcaaaggccccacatcccgataccatcacatagaggagtaggttttcaacacatgaatttgcagtggacatgaacattcagaccatagcaaatatgtatgtattgaacagaaatatatataatctgtgtctaagcttgaagccgtctacatttgagagaaccttcccaacttccactgttatacctacttgttaaaaacctgctggataggctttctctgtcacttataagcaaccgcgtcatcgtatgaccaggtagcacactgtgtgtcctgtgtatgtatctttcatggagcgctgaataaactaccgtgaatttgataccttaaacataaaaactggagaggtatttgaaatgttcacccaagcagagaatgtgttcttgtacttttctattaggagaaaatggaaaaatattattaagcaacttgattaataaggtagaatatttcttccaactgtaaaatgcctgaatttgtgtagtatttagagaaagtatattttccaaatagtacattctatttattttaactatatcaaacaaacataaatatggcttaagagacttttttttttttttttttttgagacagagtcttgctctgtcgcccaggctagagtgcagtggcacgatctcggctcactgcaagctccgcctcccgggttcacgccattcccctgcctcagcctcctgagctgggactacaggcgcccgccaccacgcccggctaatttcttttttgtatttttactagagatggggtttcactgtgttagccaggatggtctcaataatatggcttaagagactttaaaagatacatgtgtaaagcagagagagagagagagcactcctaaaatattattaaatattaaataaatattatttaatatttaaaaatattataaaaactagggtgaagtaggaggctggcattgacagacctgcctatctatagaagataaaaaagcaaataaaatttaggataatgtaagaaggaacattctagggaatagtttgtgtatagtagatttgattatctttcttgcgttataagaagtttagacaggcttcaggcttagacacagataatgtatatttctgttcagtacatacacatttgctatgatctgaatgttgtgtccacggcaaatttatatgttgaaaacctactcccagaaattcactcagaagcaacacatggtaagatggtaaaagacttaactggctggctgtgctcactctcccaccttaacctcacttttctctgcctatgatgaacaacagatctcagggaaggtcaaattccatgctgtgatttgtaattcatctaataacaaaacaggagagtaaacaattacatttattttattaattttaaatttggatgcttgttgtaggctgtgtctctttgaaaatcagatacatactgaggaggaaacacaattgactctttaacgctgtaaaaaaatcagaggtgatttttttcccatcaaagttttctattggagaaatagaatatgcagtagaaaaaaaacaggaagaaatgcatggccttagtggaaacaaacttctgcattattttttctattcattgttctggctttagatatcagcccagaagataatgacctggaggtagtggctgcctgttgggtagaggcactctttgtacctgtggagttcattccaaaagaggcagatgcccttagaatcagcttttctaattaccattactacaatctacagattcaatgcaattcctgtcaaattacgaatgtcatttttcacagaattagaaaaaaaaaatcctaaaatttatatgggaccaaacaagagcccaaatagccaaagcaatcctaagcaaaaagaacaaagttggaggcatcacattacctaactttgtttgctacaaggctgtagtaaccaaacagcatggactcgtgtaaaagtagacacttagaccagtggaacagagtagagaacaccaaaataaagccaaatacctacagccagctgctctttgacaaagcagacaaaacatgcactagggaaagggcactctattcaacaaatggtgttaggaaaattggatagacataggcagaagaattaaactggatccatttctctcaccatagacaaattaactcaaggtggattaaagacttacatgtaaggctggaaaccataaaaattctaggagaaaccctaggaaacactattctggacataggcctaggcaaagagtttatgactgagaccttgaaagaaaatgcaacaaaaacaaaaatgaataaatgagataaactaaaaagcttccgcacagcaaaataaataatcaacagagtaaatagacaatgtacagagtgagataaaatatttatgaactatacttctgaaaaaagactaatatccagaacctataaggaactcaaacaaatcagcaacaataacaacaaaaaacagataatctcattaaaagtaggcaaacatcatgaacagacagttctcaaaagaagatgtacaaatggccaacaaacatgtgaaaaaatgctcaacatcactagttatcagggaaatgtaaattaaaaccacagtgagataccaccttaccctagtcagaatagtcatttttttaaaagtcagaaaacaaatagatgttggtgtggatgtggtgaaaaagaatacctatacactgctggtgggaatgtgaattagtacagcctctatggaaagccatgtggagatttctcaaagaactaaaagtagctctactgttccatccgggaatcccactactaagtatctacccagaagaaagtaattcactgtattaaaaaaagacacctgcactcatgtgtttatcacagcacaattcacaattgcacatatatggagtcaacctaagtgcccatcaacagatgaatgaataaagacaatgagatgtgtgtatacatacacacacacacacacttcattgttttataaatatatgcacacatacaccatggaatactactcagttattaaaaaagaatgaaataatgtattttgcagcaacttggatggaaatggaggaggttttcctaagtgaagtaaccagaaacagaatgttctcacttgcaaacaggagctaagctatgggcacacaaaggtatacacagtggtgtaatggacattgcagactcagaaagagagagtgtgggagggaaacaaaggattaaaaaatcacctgttaggtataatgcacaccatttgggtgatgggtacactgaaaccccagacttcaccacaatacaatctatccatgtaacaaaaacccacttgaaccccaaaagctattgaagtaaaaggaaaaagaatcagcttttctcgcttcatgtgtttgtcgatgacccactttaacaaaatacaactaaaaatctgaatcttattagagagttaagttatgaagtgtttgtgtgctttttataagtaacacaggattttcttatagctatcaagctccatagagtttgataaaactatttaacctgcaaaatgttggtttactgattctcttatcagagacacatgtcataaatagaggcactcatagcaaaacacccctcatttttattacctgttgacaattctagccagaggattgcccatttttttacttaatcatcactcgtggccaggctgggtacagtggctaatgcctataaccttgggtctttcaaagaccgaggcaggaaaattccttgaggccaggagttcaagactatgtctctacaaaatgttttttttttaaattagtcagatgtggtggcacatatctatagtcccaactacttgagaagctgagacaggaggatccggattacttcagcctaggagttcgaggttgccatgagtcatgatcacaccactgtactccagcctaggcaacagggcgaggccctgtctcaaaaaagaaaaaaaaaaagtcataactcgtggtctctttagtggcctctggtctttttaactaatgtaaattctgacttcatttagacttaaagctattgctcattttaaagctgttcttatcttattagacctatgctcaaatcctttaatagttgaaatcaattgagctattatttattaagtaactacgatgtaaaagacaaaatactagggatcatacagataaaaagggatgagtgaaatagaaacctcattctaaagtcactggtttttttgtagagcattagttagcagctgccgtacaataaatcatgccaaaatccagtggcttaaaatagtaagaatgtattattgttcatgagtttcttggtcagctaaacagtatttctggtatctactggtctcatttatttgtttgtggtcagatgtggattaggcaggcaacttgctgagttggttgactctatcacatgttctgggagactggctagctgtagttcaagttggccttggcataatacccaggctttcctccatgtgatctcatgtcctccactagactagcctaggaaggggtgcatgaaaaaggatcaaagcacacaatgccccttgggcctggactctcggaagtggcaaattgacatttttgccatatttattggtcaaagcaagtcacaacgtgtccaaaattggtgggttcttggtctcactgacttcaagaatgaagccgtggactatcgcggtgagtgttacagttcttaaaggtggtgtgtccggagtttgttacttctgatgtttggacgtgttcggagtttcttccttctggtgggttcgtggtcttgctggcttcaggagtgaagctgcagaccttcacgatgagtgttacagctcttaaggcagccagtcgggagttgttccttcctcccgacccgagttgttcattcctcccggtgggtttgtggtctcgcaggcctcaggagtgaagctgcagaccttcatggtgagtgttacagctcataaaggcagtgcggacccaaagagtgagcaccagcaagacgtattgcaaagagcaaaagagcaaagcttccacagtgtggaaggggaccagggttgtctctgtgggcttgggcagcctgcttttagtcccttatctgaccccacccacatcctgctgattggcctattttacagagagctgattggtccattttacagagagctgattggttcgttttacagagagctgattggtccattttgacagggtgctgattggtgtgtttacaatccctgagctagacacagagtgctgattggtatatttacaatcgtctagctagacataaaagttctccaagtccccactagattagctagaggcagagcactgattggtgcatccacgaaccctgagctagacacagagtgctgattggtacatatataatcttcccgctagacataaaagttctccaagtccccacccaactcaggagcccagctggctctgactaatggatcctgtttcaggggaatgggcagaactgcctgccagtccaacacagtacctgcactcctcagcccttgggcagtggatgggactgagcgtcagggagcagggggcagtgcccgtcggggaggctcgggctgccaggagcccaccgcagggggctcagacatggtgggctgcaagccccaccccaccgggaggcagctgaggccaggtgagaattcgagcgcagcgcaggtggcccagcagtgctgggggacccggcgccccctccacagctgctggcccgggtgctaagcccctcactgcccagggccggtggcgccggccagccactcagagggcaggacctgccgagcccacacccacccggaactcgcgctggcccaggagcgcttcatgcagccctgattcccacctgcgcctctccctccacacctccccgcaagcagagggagctggctccagcctccgacagcccagagaggggctcccacattacagcaacgggctgaagggctcctcaagcgtggccagagcggatgccgagcccaaggaggcgctgagagcgagagagggccaccagcacgttgtcacttctcatcaagttagggccagattcaaggatgaggaaataggctttacaaattgatgggaagagttgtaatgtcatactgcaaagggcagtgttaaaagaaggcactcatcaagtacatgaatgcactcaatccaccaccaggagaacaacgcaagtaaaaacaattatatactctaagatattctagaaaaatgccacaagttaaatacactagactctcaacatttaggattaacttttcttttcagtttttggtaatttgtatgctgcagaaacatgagatagtttgacactttgttaggaaatacttctttatttggcaatgccttcatcattcatcttttccactgaaatttaagctccaccaagaatgtcgtcctaatcattactgtatcttaagtgtctgcaaagtacccagcacaaagtaaaaacctggcaaatacttattgaatgaattaattcatttataaaaactctaaagatatcattttacatttttaatttataatttctattacaaatttttctgctttgtaaaatggggatactttaagtacaatttcgtaggattaaatgagtttatgtatatatatatatgaagcattcaaaggagaggacaattgaaaaattgcaaatattacatatgtgtttgtgtgtataatacactaatcacttttataatatttaatgtttaattttgcatggaaaattacttactaaatgtcttggagtctggggatttgtgggttttttggagcacttactcaagtatataattccataaaccaatatagaggtttcaaaagaggcagaggtcaggggaggggataagggaagctttcacaagcaagataatacctgagatgaaactttgaaggagaagtagaattttgtgagtgcagtaggttttcaggaaaagagaacattgtgaagggagtgcagaggggtgaaaatcggcagtagaagagtaatgtatagtctgatttccaaatatactgggggaataatggaaagcaaatctggacacgtatataaagagttcagcataaatgagtctttgtagtggcctttgtgattcactagactatcaataattatccacaatcttttcagcaacagtgatttctactctgagatgaaaaaaattcatttgcagcagtgtctaaactattaaaagtgaaaaacaatagaaaattgaacgaactgggagaagactgtgagtgtttaattattaatgttttttgaagtcttgagtgaaatgacggcagtgactgaaaagagaaggaaggatgtaagaaatatttggtaacttaagatacaagggggagagtcaaaaataagtgaaatgactgcaacctacaacatccagtcggaagacatcaggggacattaagtgaaattgagaagttaggaaaaaaagaatcttttgagactagaaaggtggatgaaaataaataaattagaaatgaagatataaataatgtaaggggcagcagaatttctaactggatatctttaagggacaataaggaatatgagtttagagctcagacagcagagatgtgtatttcgtaggatcttcaccgaaggaaaagtttaatctttgggtttgtgggggtctctaaggaagaaagaggcagatgaaaattatttcagggacagctgtagaagaaggagaacatactccttgttttgaaacagattccttttcatattacttagcttaataaacacttgtgctagatttttgatctgctatgtaaaagattttagatagtctcgcaccagattagaaatactcataatagtctgtattagatccacaaatattgtccattcacgacaacaaaaaacaatgtgactagattttaggaaaatatattctgtggttgtgatctgttttcctgagaaacagaccacttttataatatttaatgtttaatataatagcacctgtttggaattacagtaaagatatcagtgtaacaggaagtatatttagggagtgattaatgatgtgctattgactgaaagtgctggttggaaacattggtggtgctgttgattccgactgaaagcgctggttggaaacattggtggtgctgttgattattatttaatgattttttttctggattgctgaataattgacactgatgagaaggtgactcagcattgattttatgtttcccagactgggtttttgaaatgtcaatagcagtagcaccttattaagtgcatcacagacagaagtaaatgtttctagtagagacttctctaaaggtttattagtgattaaatatgttagttccttataaaaatagtagaaattactattctccatttacacacaaaacagaagaataagatttttctcttaaggtatttttagatagtgacagaattagaaataggactcaatataaccttgttttggaggaaaagcataattatgctttaaatttgtgtcatatgaaaacatagttttaaaggctgtgttttattaatgaatttatcttttaaattaactcgtgttactttaaataggatctgcatttttaatataaagagcataattgggaaagaaatatagaattgattttatttcattagtatttttatttaataaaataagtagattgtaacaaatgatagtcccagtaataataaaaacattgtggggcacatatgcaaatggagaaacaagtatcttaatttgttctacttaaaacaatgaggataactttagattaccgtattgtctctagttttctaccccattttttttcaggtaacctatatttcatccttactctattcaacaactggtgtttgtgtaccacatagaatattcaaattgcagatcctgaaagagacagacgataaacagttcaattttgtgatttgtgacaagtgttttaaaaatgaaataataagctataatgagatagaataccagagtacatctcgcataatgttactatacaatactataatgtattgttttataaaacgtctgttttatgtatgttttatatatgttttacacatctaagtatatgttctgggtcgcaatgtaacgcatattttagatcaaatggaggagctactgatctattcagagatctaccctgtaaattattcctctatcacaaattagtttttaattaattaatcaaatatttattatgtgcctgctgtgtctgtgaaaattaaccacaaaaatataatttacatcatactataaatgagttgacatttggagtaagatatgttccaaataaaaaagagaactggcaaaatgaatatgtcctggggcattgttttgcagtactagcatttcatttctttgacatcttgaaactataatatacactattataatttactttcatgtgagaaatggttctaaatgtttttatgttgtaaaagtaaggtttgtaaacagtaaagggatgtgcgttgaaggtctgctgtagtatgtctgttttgcaccaacgggacaatttctatctcagagcatgtaaaccatctatggatggctcagcaatgcttcttatattcaccattgactaaagtttatttccatttttaaacaaatattttgcagcaattaccaagtgacaggtagcatctaaactgctcagagtacaatgatcaagatatgatgtgcgctggagattttagtctaatagtagacactgaaatattttaattttttattctgtgtgtttcactttggtctataaggaataaaaagaaggctcccagcaacaagggaaaaattagctaatatatagaatcattttgtcacatttctgcagatcagtgtgtgagaaactgattgatttgaagaagatagaaagtgtcgaccctaagaatacagggatataaagtcaaagaaagttgttgggtctctattagcctccagataatttattaagcttcctagagagatgagctatgtggaaactgttggctgaaatatgtttgggtataaatatgaaatggaaaaactatacttatatcactccacatcttattttcaagttctttaaaaccacttccaattttgttgtcttgagtggaaggataaagtggggcattagaaatgttcataaatgccagtctcattagaaactgtcattccacagacaatgttagattgcttccagtttcagcctagatcaccattatgatgaccttgtagacaagtgtgcatttcttttggaatctgctagactgattttgcatttaaaacagctaaagaattctacgcatatttcctctgtcatgcacaatctgtcctttaatagccttctgctttcctgttgagaacctgctgaaatgctcttatgcataaaaacagatgccccaaaattccctctcacaaccgtttttacatttatgaaagtagatttcactttcttgaagtaaattcaagatgctcaaagataaacaaaatacctcaatacagtaaaacttgcttcaagctgactaaatcaatatgttcagatacaagtattcttcagattggcaaatgtataaatcacctatttcattaaataaattataaaatttgtacaatgctatctatatacttgtaacttaatgcaattgagcagcaaggtctgactgcaaacctaagaagctcaatctgggctaagtaataaattttcaaataaaagttcaagagtaattcaagtataataaaaaaaacaagaataaatacaaaagaacgtagtagaagataaaagtgaaaatcttcattttctttctttctttctttctccttccttccttccttccttcctgtctttctttctttcttccttccttccttcctttcctctttctttctttccttctttccttctgtctttctttctttctttctttctttctttctttctttctttctttctttctttctttccttctttccttcttttcttttcttttcttttcttttctttctttttctttcttgtctcactctgtcgcccaggctggagtacagtggtgtgatcttggctcactgcctacctccaccacccgggttcaagcgattctcttgccttagcctctcgagtagctgggactacaggtgtgggccaccacatctagctaattctttgtatttttagtagagacggagtttcaccacattgcccaggctgttctggaactcctgacctcaggtgatctgcccgcctcagcctcccaaagtgctgggattacaggtgtgagccaccacacccgaccatgttttgtttttcttaatttagtgacctactttgtggcagttcattcctcaatgcataaagaataaactattcaatatattagtaaattgaaacagagaacctatgtaacaaatatgataaatacctctaaggtcactgttacctggaaggtgttcatgtctcaaccctacatgatcataagttcctcttccttaagttttggagaattaggtgctaccatagaattatttttaaaatgcagcagagaatagagcaaggctgccatatataggcattttctcccgcttattccaaaatcattatctttaattattattttgaataatgataatggtgcatactattattgtactctcaagttgtcatgaaaattcacatttggaacttaagactactggagagtcatagactaaacccgtggaggtgtctaggggccttctcagtgtagctacctcactagaacatttcaggacttgtcttagcaaatgaactcattgtgccttgttacagacttagaagagataagtttcattaaacaaagactagtgtgtttctgattactactgctccagaacaggcctcctctaacttatttgattatgctcatggattttgtgaatcagaaacgcagatagggcctagtaaagatggcttcccctgctacgtgatggccagggcctcacctgggaagatggtgtctaggggtaaatagataactagaggatgaattcatttgcagagatctttactcatacatctgcgggtagctgctggccattagccggagcatataagcatggcttgtccccatgacctcgcttcatactgtagaaagcccagcacagtaagacagcttacctggcagctcaggaatccaaaggcaggtgacccaagaaactaggaagaagctgcatggccttcattttagtacccactaaagctaaatagtatcactttcttgtattctattgcttgaagataacctgtatagttattatatgacctagattcaattcagtgagaagggacatagacctccaacacttgatagaagcgtcaaagaatttacagacagatttcagaaccccaccacagtgggtaagcactccgtagctgagatgccagagaactgcgaaggcagtcctggggtgggggtggggggtgggtactagttctgtggatggaaaggaagaggcagcactctgttcacaagattatatgcttaggacatgatctagcaacactggcatttctgaatatccctaatgtcctatccattccattcgtctactcaagacaacagaattacaaatacctgcaaagaatttgaaaataaaatgtgaaatgatgtgtaactttgccagttcgcatttatactcaagcataccttattataccaagtagtttctttgtctcttactctctgggacactctctgtccttctctaattaatctcaatgccagtattacagatacctggaaagtcatccagagaaaattatcattcaattgtcccacttctatagtataattctccaaaacaattgaaattaccattgagtcatacacatgcgcacgcacgcagacacacacacacgctcagatatatgaaaagaaaaacattagcaaacccataaacaaatagtgagataatagttttcaaggaaaaaataagctttcgaactttagaaaagaaaaattgaaattagttctaaattgatttacgcatgtgtatgtaaatatgtatgttatatatattctacatataataaacacataggtgattgaaatgatagaggtacatatgcctgaatagttatgatatgtgtattatatgtatgtgtttatacgcacagagcaataaatatgactaggcaaaatttaaaaaattaatactagtgtcattatctgttaatttgtatgttttcttattcattgtcatagaattcctggcattatttttctaaatgtataatatgggactaaacctaatgaatactctttcaatgcaaaggcacacctacatactctaagtggttgctattcaaccaggaatatgttggcagagaagaattaaaatcactgccattttacggctaacacacactgattttctggatggaacatttggttacactatactttcattaaataatatagtaattatcacttttgcaagatgttattctattcatttgcatgtactttaccatgctacatattggatacaaaataattagatactgaaaaagaggagttaaaatgtgggtaaaaaatctgctgtggcttccaacataggcaactagtagagacagatggaactgtgttcttgggatgtttaaggacttttagagtactttgcatcagcagcatctagagaccaattactgaatactctctgcaggagtcttgcctcagggtttttaaatggatgaataatatataaactccatggtttcccactgagagagactgaagcagcatcagaaagagtctatttgagttgaactaaaaatgaaataatttgaaatttgacctgaagtcttttgtgtttacatatgtagttggttgtaaggttgcaatgcaggggcataataaatagaaaaaaaatgctataagctttttccttttctgagtctgggtaaaaatgaatgagaatggagaattaatctttcaattcataccccaaaaatagtttataaaataatttctaatatgttactggaagaaattttctgcatttttaaagccctaaagtatcttggagcaccttatagattgtttatttcaaactcttcatattacatattagtttctagacacctgagaagcttaatgaatacacagttattaacagagatggcacaatatttggatgctcatgctactctatctcacttctgagatcacattatataataactacaaaataataatatcttcaacaataacaatacaatgaaatattcatttacattgtctcattttaacaacaacactctgtggtgtgccagtattaatcattttaatagtgagaaagataagagaagcagacccaagaatctgtaccaggcctgagagttcaatgtctttgctgaaacttataaaatctacctgtgcatgttttctgaaagagtcagattgtaccgcaaggtcagtaagatgcataaagtcacgttgaagacttcgatagcccgttcattcatttattcatttataagtatttatgaagcacatatctctcccatatgccaagcaaggagatggggctagggataaatcagtgaacaagacacaggtagtccttggcccatgtagtcaggaccttatgttgtcaaaaacaaagacaaaaaaaaaactgccttgggaaattaaccaagctgctgttatggcattttacatgtgagaaaacagtagtaacattagcatggacaaattctaacctaggtctcgtaatttctagaatgagttagtgttcccacaccagtaatcaaattattattacttaataagaataatcatcatttaattcaaattaaataattaagagcttggttggcttcaatttaggtgtgtaaataaattttatgaattatccatggtctgcctttccatttttccttgcttttttttattatttatttagtgggtaaaaacaaacaaaaacaaaaggtgaggtaaatactgatgtagaaaattttaaataattacattttgatgactagttgtggtttcttttaaaagaatcatttggagtaatatggactgtgtgttattactcatccaagttctggctcgtattgacaatttgagtaataaaagtttgtgagactaggagtgaaaaatctggactggaagggaagacctctgcctactctcttgagtatgaagtttaccaggatggttgctctctagacaaaactcataagcaatgcattcaaagagaatatgtgtagactaggagataaaataggctggaaagataaggtttatcttgtaaacactgaatttattttgcttttgatatttcctaccttaaggactttttaaaaattatctcttttttatttcaactatcttcagattgttaaggaaaaagttctatgtcaacacttgtaccaataacaaaagtgattacagaggcaatatgatgatggcattggtgttcctcaaaagaaatatggaaattgaaagatgaatatctaagcattttaatgttagagcattcttacacaaatgtgaggaagcaggttttattttataatggaaggctgaaatttcattcattcatttatttccaaatatccattgagtggttctaacctgccaggtactatgttaggctatagggtcataacaatggggaacacggaagcggtctattcactcataaagtcagcatcacagctatcaccttacacagcttaggttaggttaagaaaaaattgcgtattattttttcttaactaacaaacccttttatcaaatgacttttatgtagatccccaaaatataaaatccattagtgtgatatttacttttatagatattatatctaagtgcacatttctaatattggcttatagaggtgttcaataaaaccaatgagattttttgaaggaaaaaaattgaaaatggagatcataaatgataactcagaaactcacacttctgtcagcttcaaaatccaatttatctctatattttagtttggctgcactgtcactcagagtaagcagtctgaatcctgacatgtacaatagtattcaatattacttttttattttaaaaaatgttggcaatttgaagaaactttttaattaatttcttaatacacctgaaagattagtgggaagaaatttttgtttcaaatccaaatagatctaacacatgctcgcagtataatagttcagagtttagcatttgaggtgaaaaactttgtctttatttctaattggcatcttactgaatgtgcagtcatgggaaaactacttaactggcctatgattcagtttccctaattctaaaatggagatggtaataccagagttgcctgaagaattacataaaaaatatgtaaaactacttgggtcatactaaatgtttaatataacatgcttaggttttaatcttatttattaaataaaagtcatggttggggaagtacgtttatcccagtgtctgaaatccagcatagttcaagtcaccaaatttgtttaacaactgtgtgtctgcatgcgcaaagaggtggtaacagtaacaaagaggctgccaagtcccatgcttggtgggagaattcagtcaaagacacatatctaacttactattatgcttttaatcttagacttgctagtaagaactaataaacatcaaaatgttatatatgtaacatttaagagaacatcaaatacactattttttaaatatcaaatatacccatacataataataattttattatctttccttggcttaaattctggtaaatttccaaaaagaaaaatcaagtgtttttcaacagtgttttgaattaaaacttgattatttttgcaagacattttttgtttcccactaactcaaatgtaaataatattttgagagtttcaatgggttgctaccactaacagaaagagcaattttaaaagtttaaacagacactgtcttggaacttcggctaaggaaaattactaaaaactaaaagatattcacttttatgtcagaaatagattatgtcaaacagaaaaagtacttttactaggaaggacaattacattgcatgaccaaattcatgaaggttacagattcgtttcctgaactgctaactcaggataaccaatatttccaacacttacttggtaccaggtttaaccgacaaaaatgtgatacatatgatatgtagctagagattattcataaccttaactgacctttaaaaaaaactttctgaaataggtctctaacctcttctcagaggaggcttatcagcaagtttagctaaataggcagtgagttccgtgctgcattttgataagaatgccccctgtttagaaagcttcatggaagtattgccagaaatgcaattatttgattaatgttagaacctatattaagggcattaatagctttttagtccatgagtcctcaattaaaattcagactctgagtaaagccttgtttcctcataccctccccttccaagctcaatcctcttgacaaatattcactctccttttaagattcggttgctatttggatcaccttaaactctctccctccaaaattcttcccagctagaatgtaggtctctctgtgtttttttaacctatatattttacctgtacatacttctagtacagctctttaagaaagaaaatgtgtcaattatcttttatcccacagaaccaagcactatattctttgtatatagcaacataattgtatttgtatgaaagaagtgggcaaccaaaataaaatgtattcactgccttatttttgtcaggcactgtacaaagctcttgaaataagagctctttaagatacgtaatattacgattccttcatgaagatattgtcagccttgctatatagaagtaacgactggggattaaataagttaaatataaaacccaagtttttgattcacagcatcaggatacaaatccaaatttctttctcatactctcatgacattttcttttgagaacctgatactgagataattaaccaagtcttttctcagcattctctccatatgccctctattggtcagggttctgcagagggacagaactaacaggatagatgaatatatgaaggggagtttattgagtattgactcacatggtcgcaaggtgaagtcccacaataggccttctgcaaactggggagcagggaagccagtccgagtcccaaaaccacaaaagttgagaagtcaacagtgcagccttcagtctgtggccaaaagcccaagagctcctgacaaaccactggcataagtccaagagagcaaaagctgaagaacttggagtctgatgttcaagggtaggaagcatccagcatgggagaaagatgaaggtcagaagactcagcaagtccagtccatccatgctcttctgcctgctttattctagccgcactggcagctgattaggtggtgcccacccgtattgagggtgggtctgcctttcccagtccactgactcaaatgttagtctcctttggcaacaccctcacagacacacccaggaacaatactttgcatcatttgcaatcaagttgacactcaatgttaaccatcatacaccctcactgaacacctcatggaggcgcctggtagctagctagacagcaagggagtgactgtaatatgaagacagaattcaggaatcctaggaaaggtagctaaagggaaagagagcaatcagagtggatgcctggcaggtttttacagtataacaaattaagcatgctcacatgctgaagggtaagactcacaagttgagaaaaggctaaaatataggcaaaaggtgaggtaaccataggacaaatctatgacaaagcaagaagaaaagagactcaaagaagagttccaagtaccatcggtcaagaggcagggcagtcgcttgcagggaacttggcaaagatgagaaggtgtcactccagctctacactcctgactgctgaagcgaggaggcttaatgtatccagcacagtcttactattagctggttaacactttctaggccagtaaatttaattgtatccttatctgtggccaccaaattctctcctgtcctctctcccctctgctgtgtcttttggcccttgaaaccttagactcctcccgcttttgtcctccagaggacaatggtgtcctgtgtgattggtccagcactctatatactatacggttctgctgctggacagaaacagagcttcagcctctaaaggtggaggagggatggtgggaaaatgcctttagtactttgcttttcaatcatcaatgtgtagatgggagtctaattaaaatgcagattctgattctctgggtctgaattggaacctgtgagtctgcatttctaataagcttctattgatgttaaggttgctcatctgcaaaccacattttgagtagcaagactagagtttcaaatctaagggaaaaaaattaaagatggttctacttctaattcaaaatgtggtggtgaaatatcctctccctttttagttggcctcatagaggtgactatcccttatcaaaacactctgagaacctcaaagcttgccaagaattgcataaaacatctaaaagtaataaactataccgtttgtgcgtttttgtatgttatgacaactaatagaaatttgactcagtgtgtaacttccacggatctgaatctctgtcatcactgctgcattttttagactgatttttaatctctcatacaaaagtgtagatggaaatgtgaaaaaacaattgtaatccaaatattctgtactcccaattccttcttaaacaactgttattctactcacttccagtatgtactttgaccttacaaattttgcaaaaggtccatagaatgtactacaagagtaccaaattttacaaaatagatgaatttatgagaattggctaaagagtcaatttctgtctcttggatttctagaaataagttatatttttcttttaaattttattaataaattatagttgtggccaggtgcagtggctcacgcctgtaatcccagcactttgggaggctgaggtgggagaatcgcttgggaccaggagttcaacacaaacctgggcaacatagtgagatatcatagctacaaaataaaaaataaaaaaattaggcaaacacctgtagttccagctactcaggaagctgaggtggggggatcacttgaacccaggagttcgaggctgcagtgagttatgatcaggccactccactccagcctgggcaacagagtaagaccttatctcaaaaaataattaattagttgtacttagtgatacagaaatattttaaatatttaatttaaaatggtaacaatgtagtagcgatactggtgaactcttagtagagatttagatctaaattctatctcagccactgctagtgctaagattttgggaaaataacttatttgcacctcagttccctcatgtgcaaaagattaaacttatattacatgattcctttcagtgttatcattatgtgattatttaaacatgaaaaataattctcaaagcatgttcagttagttttcaatttgaaactgtagtttgaaaataaaatgtaaaatcacagtgacttcctaaaagataatagctaagctaaaaaataaagtgcctttcaatcagtctaaaattctctcctgcaggatactgtatcttttaatttctaatcagtttattgaagctgctgattcatttataggttggtcattgtaagagggatttatagtagaaacttacagaatctgaagtctgaaatgcagcagtcaatgaataagtatttaagcacaattattgaattcaatgaagagtaaattaatgaatagtaatggttcgattataagtttctgccagaactcctgaaactgcataatgatttccctccctgatttataatgataagcatatgcttattatgttcttataaaatgaggcaaattctttgcacatcaaaattacctgatgatttttctaaaaatacagctactggatccacccctgtgggaactgattgaatgtgaaaaacaacaaagcttgaaaaaccctctaatacatcatttaatcagtcatacctaacaccagctttcatgattcatccacagtgtgtgacttgaagcatcagaagtgtcagtcttattattaggtccctgttcagcatctttctgtcatacagagcagatgtagtattgggcttagtgtctatgaaatagttatgtaacaattattcaaaaaatccctgggcatatcagaagttactttcttataatcctcatttttctctgaagctgaagaatcactgtggtcattatttttagatattctctggtagtgcagaaaaatacgaaaggaaagggtgattaccatgttctaagttgtcactttcctgttttatgaagacaaactcataagaagacataggttctagtggtaaattttggtaagaaaatgccaggagaatttataaacatctccatccccaacagccaaaatatattcacttctataaagatctgcttttatcaagagtaacagactttggggaatgtcacatttcttttttttttgtttttttgagatggagtcttgctctgtcgccaggctggagtgcagtgacgcaatctcagctcactgtaacctccgcctcccaggttccagcgactctcctgcctcagcctcctgagtagctgggactacaggcacgcaccaccacacccggctaatttttgtacttttagtagagacagggtttcaccttgttgccaggatggtctctatctcttgacctcgtgatccatctgcctcaacctcccaaagtgctgggattataggcatgagccaccgcacccagctgaatgtcacatttcattctggttttagtaatatctatattagttagagtaaactgcttgttttaatgttgtgttggcctccaaatatatttacaaaggtggtcatttaaaaaaattttatactaaaataaatgtgtactctatagtataaattttttacacatttatactctaatattatgcaaacattcattttcagtaatttttatatgtatgttattaattttgtgggttacaaagagaaatatatccatttgggagggaaggcattgggtgatacatctaatttttattttgagtctcagagtaaatacgagttttaaatctcctaagcaactacttataaattcaggttaactgaaaagctataaaataagtgcagatgagaatcacataattacattatataaggttgtagcttaatggaactatatcgactgagctgcatttttagagcttagttctatgatcaactcgatgtatgatgaacaggttttcaaggctatatgcctcaaaatttttaacacagaatgggcagctctttatgaaaaaaaattattcataagtaaatcactgtgtgatatctattttgctccaaagttttgttatagttatggctgccttctaaaatgacattgaagtaacataatgcacatttgcaagacaatttctaaatgtaaaaaccttacttagtctggcataaataagacttgatgaagccatgcaaggtggggctagtcagtattgcactccttcttccaccaaacccgcccacctatctagtcctccactatatctcaaccaggagatggctaagaataaaataaataatacaatacataataaaaataaaagattaaacgttcctatggactgcaagtttgcatgtctccaaaattcatatgttgaagcttcaatccctatggtgatgatggcaactggaggtggtgctttggggaggtaattcagtcatacagatggagctcctatgacaggattagcaccttataagaggagactcaagagagatgatctctctccaccatgtcaagatacagcaaaaagtcagccatctgcaaagcaggaggaaggccctcacaagactgaatctgccagcaccttcgtcttagatttcccagcctccagagctgtcggaaataaatgtttgttacttaagctacacagtctatggcattttgttatagcaccctgaattaactaaaacaaataagatccagagtttcataatataatatccaaaatatccaggacagaataaaaagttactcatcataccataaagcaggaaagtaacttgaatgagaaaagagaatcaacagaagctaataatcagaaggtggaattagctgaaaaagattcaaagcattgtacaaatgcttcacctaacagtaaagagttctcatgcaacaaatgaaaatacagaaaatctcaccaaagaaatagaagctatttacaacgagtagaaatactaaaaccaaattttaaaactcactgcatggtctcaatgggatagaatcagtgaacttgaggataggtcactctatctgaaaaacagagaaaatacactgaaaagaaatgaacgtaggcatagggaactacgtaagagtagccaaaagagctaataattcttaccatcagaataattcttacctctcttacagaaagagaggacagagggaatacaaccaaaaaaaatttggagtaaaaatagctgaaaaatttataaatgggtcaaaatatataaacttacaggaagctgagtaaatcccaaatataataaattcaaagaaatgtatgtcaagacatatcattgttaaacttctgaaagctaagccaggcatggtggctcatgcctataatccaagcactttgggaagctgagacaggaggatcacctgagctcaggagtgcgagaccagcctgagcaacataatgagaccttgtatctatgaaaaatagaaaaattagccaggtatggtgatgtacacctgtagtgccagctactccaaaggctgagacaggaggatggcttgagcctggaagatcgaggctgtagtgagccataatagcatcactacactccagcctgggtgacagagagggcccccatctcagagcaaaacaaaacctctgaaaactaaaaacaaagaattgtcttgaaagcaggaagtgaggaatgacacatcctgtaaaggagaacaccaatataagtctctcacctgaaactatggaggccagaaggaagtagcacaatatttttcaaataatttttttaaaatctaccaactgtgagttccatgtctagcaaaaataatgttcaggaaaaaaaaatcaagcaaatctaccattacagagcagcttaaggaagtttttttttttgttttttgtttttttaaagaaaggaaatgataacttaagacggcttggaacttcagaaaggaaaaaagtacatctgcatgaggcaaaaataggagtaaatagaatatccttatgagtgtcttaaatcatatttgacggttgaagcaaagattaaaatgtcatctgatgcggtgctcaatgtatgtagaggaaatagttaattatagtgttaacatggggaggttaaagagacctaaatagaagtaagttccctatgtttcacaaatagtggtaaattgtcaaaaccagtagactactatacaagagatccttgtgatgaaactgtcctatatcttgactgtgacagtagtcacatgactctacacatgtgataaaattggtagaactaaatatacatgcacacacttccacaaatgagtacatgcataactggtgaaatctgtattaggtcaatggattgtaacaatgtgatttcctgactgtgatattgtactgcacttatgcaagatgttaccatttggagaaactgggtaaagggtatgtgaaatttctgtattatttcttacaactgcaagtgaatctacaattacctcaaaataaaaaggcaacatttttaaaaaccttatttagttatcaaatgcagctttattaatcaaaaatttcaaacataaaggatatttctcataactcatacatgccaagattttttgctagacttattgtggatatgtaaaatggacccccaaatcttaaagcttagtaaagtaaataaaatctttgaaatacacaaagaaacactaaaaaaatcagtcttaaagcagttcagagaaagaaaaattcatcatcagtcagaatgagagagaaatactctctttcacaaaacactgaagttgctaagtatgtacttacaggagacatatctagatccctatttcatcaattgtccgtgaatttctattgaaattctctaaatgagagaccacaatatacttggatgccatctcagcatatagaccttgtagctgtagtccacataaatatgatccaggtgttactaataagatagagttgccttatttaaaaaaattaaactatcttcccaaaatatgtataagcctcctatagttgactatagttggtgagactattttaccatattatttcattataatggtgcatctgaacacaggtacaattgtagtttcgataaaaattgcagtcactaaagaattagcattttaatacacagtagataatataaatggccttagtttccaaatgattagcaagcatacatttcctactgcaaagaattttactcattaaaatacactttatgggagtaatagatatgtactatgtgtttgttagcgaccacaaatataatgtactgaacaccttgtcaacaaatcgcatacatactccttccagctatttacactatcgacttggtaaaactatttgtatcacaaattataactttatataaatcccatgtatcatgggcttctttgtgaagctcagaataatccaaaattcttcacaactccagctagactgttactaaactcatttcattctgatgtgccttttaaaaactccataatattttatgttgccttacaaattcaggagctacaggtcatttattccagtgctctgacagttctcatgaactatctctttactatttgaattacagtttagtcaacttcaagttataactatggtgaacattgattaaaattagtcatttttcaaatcacaacattcaactcatagatgtgagcactttggctcatctatttgatccttcattcaagggatgatgaaacagattggaagtatgcctctaagaaactgagcttcagagcaaaacaaactctctaccccaaagcatcattaatgtgtcctaaactgtgtatattaaagaatgaaaagtccttagatttttaagcaccatgactttccaaaaatcaagttagtttaataaggcaaaaactacctttagtaaagacataaagaagtattgagcacttacactgtattctagaagaacacaacatcatgtggggtagattaaacgttagcatcaaatgttacagactgaaactcaggcagaggttaagtcacttgctcccaaccacagcaggagttctgtcacggtcaagagcagcatggccttcttacactttcagtccaggcccaagattaatctttcaagaggaaaggatttaatggagaaagcttgtaaatattcatgaagtaatagcaaactaaatattacagaaatctcggataacgtttaaatgctcaaaattgccacctacataaatggaaccaagattctcaaaagaatgtaaaacatgagagtttgtgtaattaaaagttaaagaagcaaaaagactcctgagtcacattgtcgtgatgtggcattaaagtacttgtgtgggaagggttggtcaaatcctaagattgtcccaagaattgctatttattaaagttcttattactagattaaccacaggaaaacttaattggccattagctttaaagaaaaacatctatggaagcaaaataccttattaaatatttaacaggacatggcctacatattgcttaatttagataatctaattatagcaagctaatgcacttagctcatcatcataatacttgaaattatttacctgaatttggctcatcctgactttggttcctatgttatatttcttatgcaattgttttaccataaaatgtctttacttaaacaatttttcaatacaggatcatgagtgcttaaactatatatatctagtttgaacatgtacatagagtagtatatatatatatatatatatatgtattagttttttgtgaaaagacttgtggttctagttggcacttcatctaacaatttagcatgtaaaattaatacagatacttaaaaaatgtacactactatggaatttacaaaaatgttacagaagtgaattcaacaatgtacagacaggtacactatatggatacatttaaccaaaaaaaaaagtaatattctaaacagaaaacatcagcacagagggcagattaaattaagtgcgagaggcaataaagtttacatcagaatgggcaagtaatgcccaaggaaaatttgatcattaaaagggaaacaggtgtaaggacagagtccaagcacagatcacgcctgtaatcctagcccattgggaggccgaggcagatggatcacgtgaggtcaggagttcaagaccagcctgcccaacatggtgaaatcccgtctgtactaaaaatacaaaaattagcttggcatggtggtgcgtgcctgtaatcccagctacttgggaggctgaggcaggagaagctcttgaactctaggactctaggaggtggaggttgcagtgagccaagatggtacactacactccagcctgggcaacagagcgagactctgtctcaaaaaaaaaaaaaaaaaaaactcacaccttgttgatattggtcctattccaggagataggtaaaatgtacattaattttcaggtagattaatttgtattgttcttacatgtcctattcatcagtttattgttcaactaattctgaattctgcacaattgactcttaatagcacattgccttgcaatagcagcccacacttcctacctgcgaagtcatcagtctcaataacttagtctatggaaggtagttttggagcaaggtgcccatcaagattaggtttcttccctcccagggaaaccaatagataggggtgcttcttccttgatgattacatttcagaaatggttcccagatccttgagaaagatattcctgggtcataaagctaagaggcttatttcacttcaaagagactgaaaattgattcacaagtttgttcttttttaaaagtaaatgctctaaaaaaaaaaaaaaaaagaagtaatggggggatggagtctctccccttattttcaacagggaggacgaggcctcttattttccatttgtctttgcctgtacagtcttcaccatacagcacataactcaaagcttcacatacacaagtcaaataacatctattaaaatgagattttatcccatcttacgtgccttgtaaatgtgtatattcttcagaaaatacagacattttggaaacacatttgtgtaagtttaatgatttaatttatgtttctttattttcactttttttaaactgaaaggtcttgctaaatgagaactggcataaattactgtctcaggactgtgctgagaattaggttctgggaatgataagaaaggaaatttttttctaagtgattataatgtcattttcaagttatgcatttcaggtaaattcaattacttttttcccatatctcaaatttatgagtaatttttcaaataattatattaacatgaaaattctgttaaaacagacaatttgtacttttcagaacagacaatttcggagtggcaactgcatatttcagttgttaattcacaacaatgtatatgtgattatccatagtgatggtgagatttgggttccaacacttcaaggaaactcttgcatagattcatttatttgctttacaaggaggaatgactcaaacacagtcctttggagctagaatcagtctatcaaaaagtcatttctccatagaccagggatgttttaaccaatgccacttcacagagagggactttggaaaaagtagtacataagtgcacacattgctcagaaatatttccagagatttcagtattgatgcgtgaatgttgggtatgtgctggcctatcaaaacaatggcctttcttgattttataactatttcctatttaacattcttcaaggcttaaatatattttcctctggtaatgagcagaggaaaggatattttcctctggtaatgagcaggccatggaatctttaaaatactttgtggcccagtgagctttatatttcttttactgttttcctctaatccagaattagagtccctatacacactgactatatttcagtataattttaactacaaggaaaaagctgtgggtctggactttcagagcttggactctgaaaataacaagctaatagaggaccaggtaagtgcacacttcctccccagcaaggcagacagggtaagtgctcacattaaggattaaacaaatgtctgactcagacatttgagggccttagaaacacaatgaaagtttagttgggagtaaaaccatccctataaactttaagcaataaatccggaaagaagagagggaaagaaacaaaaatacaccaagctcgcagcacattcagcattatcattaggtcagcatactctccggcatgcttcctcacagtcatttggagcctattgtcccagagtcatgtggaccctagattatagttccccttaactgctatatggataacaacctgaacattacgagacattaagttttccctctgagatattcattcagcacctgcataccagtgaaactactgatgtcagctgatatgaatgtctccatgaagagctgtctcaacaaagaatgcagtttccacatcctgatgattccatcctcctcacctcaaccaagcaatgacctcaactttccagccactcaccctccatgatcctcataaaaaccgactcaaactcattggagagatggagttgagggtgtcctcttatcaacaccctcagctgtcctacgatcattaaactctttctctgctgaaaactctgctgtctcagtatattggtatgttactgcactaccacataggaacctgttggtcctataacagaagtgacaagtttagagctgtgctctaaaatgaccttatcagcatctcctaaatatctctaaatggtctctccattatccccaccactgtgtctcctctctaccactcttaccacgccaacccatgtctctattctgaatgactcagcagatttctggtcaatctctgcttccccttgcctttctccagtcagttctccatacagcaaccagaatcatgctttaaaaaaaatcttactatgcatttccctgcttacagtaattcaataacttcccactgcattaaaaacccaagctgtcatcctggcctctgagccactcaccactactcatgagtacacaggccaaggcccttggcttcctgaagtttcgctgaaaaattaactcacaaaaggcgggttaattggagaaaaaaatacaaatttatttaatgtgtatacacaggagccttcagaatgaagacccaaacatataggagaaatggtttatgtttatgcttaggctcaacaaagtacaaatcgctatgcagaaatatgattgaacaaaaagggtacgatctaatgctaacaaactaagggggaaaaaacagcaaggcctatctgtctagattttacttgacctctctgggcatgcatttcttccttctgggtgtgggaaaggaccctcttggaaatgaggatcttatgacctacagtcaaacaagataagtcagataatttctttatagccaaattttacaaaggatctggggaaaattagagtaatatttttaggtattgtggttggctttggggaaataggttctggtttctgtgaccagcattggggaaagggattctaatttctatggctagcctttgggaagaatgagactgggaggcagaagggcagaagaaggtcgggaaaaaacctctgaggctgtttatgaggccttcattttgaggtattgttttctgagtccccacataagccttctggttcctcctcctacatgccaagttcattcattctctagggcctttgcatagagctgtctcctcttccagaaatgctcttctctgcaaaacatggctcgattctattcatttagatctcagcttatctatcacatcccaaaagagatcaactctattcaccacaaggagtcactaagtcactttccatcacctacttgcaattttattttttagtgttttggtgacctataagccttctgaccaaaatttaagttccatggaagcagtatcattgtctgtcttgttcagtattatttctccagcaccagcaaattgcttggtacataataggccctcaataaatattttttaaatgagtgaacatacaatagccttatttgaagagttgaaaagcaaaactataaataaggaagcaattactgagataccattactgagatactcctggaagaagtaatgaaagtttgatgtagaattatgatagaaaaggaaaaagtgaactgatgtgagagttgttttgtaggaacagcggtacatggaaaacgttttagcatggggataaagactttcctttaaatagatatacgttaaacaggaaagtatagagggtgcatcatactaaagattatagagaaatgataaaaaagcgtttgtgttaaataaataatcaattgatcattggtggtctcagagactatattttcagcagactgaagaataatcaggactgatatgtaaccaatacacattagtatgacctatatattttaaaattactcctagctacaagcatgatttctactggtgaagaaatgtttttaaaaaatttaagcagcaggcatagaaaaaccatttttcaagaagttcgatgatgacatacagcatggttttctgtgaaatattgtatgagtggccagggatgacttttttcattatttcagtaggttttttgggaaacaggtgtttggttgtgtggataacttctttagtggtgatttctgagattttggtgcacccatcaactgagcagtgtacactgtacccactgtacccagcaattatcttttgccccccttctccctgagtccccaaatttcactgtacaattttaatgcctttgcatcctcatagcttagccaccacttataagtgagaacatacgacatttggttttccattcctgagttacttcacttagaataatggtttccaattccatccagtttgctgtgaatgccattatttcatttcctttttatgtctgagtagtattccatggtgtatatataccacatttttttttaatcaactcattgattgatgggcatttgggctggctccatattttgcaattgtgaattgtgctgctataaacatgtgtgtgtgtcttttttgtataatgactttttttcctctgagtacatacccagtagtgggattgctggatcaacagtagattttctattagttttccatactagatccatactagtagaattgctagatcaagtggcagatctactattggttctccacactgctttctgtagtggttgtactagtttacattcctaccagcagtacctactagtttacattcctaccaccacatccatgagaacatctattatttttttattatggtcattcttgcaggagtaacgtggtattccattgtggttttgatttgcatttccctcataattagtgatattgagcattttttaatatgtgtgttggccatttgtatatcttcttttgagaattgtctattcatgtctttagcccactttttgatgggattctttgggtttttttcttgctgatttgtttgagttcactgtagattctggctattagtactttgctgaatgcatagttttagaagactttctcccactctgtgggttgtctgtttactctgatgattatttcttttgctgtgcagaagcttttgagttttaagtctcatctgtttatctttgtttttgttgcatttgcttgtgggttcttggccatgaagtctttgcctaagccaatgtctcaaagcattttccaatgttctagaatctttatggttttaggtcttagatttaagtctttgatccatcttgaattgatttgtgtataaggtgagagatgaggatccagtttctttcttctacatgtggctagccaatcatcccagcaccatttgttgagtagggtgtcctttctgcacttaatgtttttatttgctttgtcacaaatcaattggctgtaagcatttggcattatttctgggctctattctgttccattcatctatgtgcccattttgatgccagtaccatgctgttttggtgactatagccttgtagtatagtttggggtaaggtaatgtgatgcctccagatttgttctgtttccttagtcttgctttggctatgtgggctcttttttggttttatatgaatttgagaattgatttttctagttatgtgaagaatgatgacagtattttgatgggaattgcattgaatttgtagatcccgtttggcagtatggtccttttcacaatattgattcttcccatccatgagcatgggatgtgtttccatttgtttgtgttgtctatgatttctttcagcagtgttttgtagttttccttgtagaggtctttcacttcattggttaggtattcttaagtattttattttacttttgcaactagtataaaaaggggttgagttcttgaattgattatcagtgtggttactgttggtatataacagtactactgatttgtgtatatgaattttgtatcctgaaactttactgaatgcatttatcagtactaggagctttgtggatgagtctttagagttttctaggtatacgatcttctactccatgatcagtgacagtttgatttcttctttgctgatttggatgtcattatttctttctcttgtctgactgctgttcctagggcttccagtactatgttgaatagaagtagtgaaagtgtgcatccttgtcttgttccagttctcatggagaatgcattcagcttttccccattctgtataatgctggctgtgggtttgtcatagatggcttttattaccttaagtatgtcctttctatgccaattttgttgagcattttaatgataaagggatactggattttgtcaaatatttattctgggtctattgagatgatcatgtgattttttgtttttaattctgtttatgtggtatattattatttattgccttgcatatgttaaactatctctgcatccctaggatgaaacccacttgatcacggtgaattatctttttgatatgctgttagatttgcttagctagttattttattgaggatttttgcatctatgttcttcagggatattggtctgtagttttctttttttgttatgtcttttcctggtttttgtattagggtgatacttgcttcatagaatgatttagggaggattccctctttctcttatcttttggaatagtgtcagtagaattgctaccaattcttctttgaatgtctaatataattcagctgtgaatccagctggtcctgaactttttttgttgataacttttttaattgccatttcaatctcactgcattattggtctcttcagagtttctatttcttcctgatttaatctaggagagttggatatttacagaaatttatccatctcctctaggttttctagtttgtgcacataaatatattcatagtagccttcaatgatcttttgtgtttctgtggtatcagctgtaatatctcctatttcatttccagttgcgcttatttggatcttctcttttctttcgttggttaatctcactaacggtctatcaatttgatttatcttttcaaagaaccagctttttaatttatcttttgtatttcttttgtttcaatttcatttagttctgctctgatctttgctatttcttttcttctgctgggtttgggtttagtttgttcttgtttctccagttccttgatgtgtgaccttagattgtctatttgtgctctttcagactttttgatgtaggaatttcatcctgtgaacttcctcatagcatgacttttgctgtatcccagaggttttgataggttgtatcactattatcattaagttcaaggaatttttttatttccatctttatttcattgttgacccaacaaacattctggagcagattatttaattttcatggacttgcatggttttgaggattccttttggagttgttttccaattttattccactgtggtctgagagagtacttgatataattttggctctcttaaatttattgaaacttgtgttgtagtctatcatatagtctatcttggagaatgttccatgagctgataaatgagtatatattctgcagttgctgggtagaatgttctggaaatatctgtgaagtccatttgttctagggtacagtttaagtccattgttctttgcagactttctgtgttggtgacccttctagtgctgtcagtggagtattgtagtcccccactactattgtgttgccatgtatctcatttcttatgtctagtagtaattgttgtataaatttgggagctccagtgttaggtagatatatagttagaattgtgatattttcttgttggactagatcttttatcattatataacgtcatcctttatcttttttttactgttggtgctttaaagtctattttgtctgagatagaaatagctactcctgctcacttttgctgtccatctgcatggaatatctttttccacccccttaccttaagtttatatgagtctttatgtgttagatgagtttcttgaagacaatagatacttgtttggtgaattcttatccattctgccattctgtatcttttaagtggagcatttaggccatttacattcagctgtagtattgagatgtgaggtactattctattcatcatgctagttgttgcttgaatactctttttttttccattgtgttattattttatatgtcctgtgaggtttatgctctaagaaggttctattttggtgtattttgaggttttgtttcaagatgtagagctcctttttaacagttcttgtagtgctggcttggtagtggcaagttctctcatcatttgtttgtctgaaaaagactgtatctttccttcatttataagactttgtttagctggataccaaactcttggccaacaattgttttgtttaaggaggctaaacatagtacccccatctcttctagcttgcagggtttctgctgagaaatctgccgttaatctgataggttttcctttataggttacctgatgcttttgcctcacagctgttaagattctttcattctttctttcatcttcattttagttaacttgatggctatttgtctagttggttatctttttgcaatgaatttcctgggtgttttttgagcttcttgtatttggatgcctaaatctccagcaaggcaagggaaatttattgagggaattagtccctcaaatttggtttccaaacttttagatgcatcttctttctcgggcatagcaattgttcttaggtttggttaacaaaatcccagccttcttggtagctttgttcatattttttttaattcttctttctttgtctttgtcagatgaaattaattgaaaagccttgtcttcaagctctgaagttctttcttctacttgtttgattctattgctgagaccttccagtgcattttgcatttctctaagtatgtcctttatttccagaagttgtgattgttttttatttacctgtagcattttaaaatttctttatgttgatatttacctttctctggttcctctctgagtagcttaataatcgaacttctgaattctttttctggcaattcagatatttattcttggtttggatccattcctggtgagctagggtgatcttttgggggtgttaaagagccctttttgtcatattatcagaattgtttttctgattccttctcatttgagtagactatgtcagaggaaagatctgggactcaaaaactgctcttcagattcttttgtcccacagggtactcccttgatgtggtgcttcccctagggatggggcttcctgagagccagattgcagcaattgatatttctcttctgggtctagccaaccagcggagctgcctggctctaggctgctactagggagtgtctacaaagagccccatgaggttatcatcctcgggtctctcagctgtggataccagcacctgctctgttggaggtaggagtggagtgaggtggactctgtgtgggaccttgactttcgttttgtttagtgcacttgttttctcgtatgctggttgtgctggcagtaaagttgtcatgtagacatactgaggatctctggttagacaagatgttacaggtggtaaagttagctgttgtttttctcctttgtggggcagggttgttcttttatgagttgctgtaatggcttgagttggttggcctccagccaagaggtgatgctttcaagacagcatcagctgtggtagtatagaagggatacaagcttgccctaaggtcacctggataagtactcaggtttctcaggtggtgggtgtggccacagagctcccaagagattatgtcttttgtcttctactatcagggtgggtactgaaaaaccatcaggtgagggcagggttaggaatgcctgaactcagactctccttgggcagggcttttggggtgtggttctcaggcctatggagttatgttcccagggggattatgactgcctctgctgcatcctacaggtcaccagtgaagtgggggaaagctggcagtgccaggcctcacccagctcccatacagccagaaaggccagtctcctgctgtgcccctccagcagcactgagtttatatccaggcagccagcgagcagggctgggactttgccgcaagctaccagtctctctgccgagaaatcaagcagggctttcagcttcacctctccctactatggcttctgtgctcatatctgcacttcccatttgccctccacccccagattctgccctgaaaaattttcactcagttgaaattactacaaagttcagctgaaagtttccttcttcctgtagtctttccccagttccactggcaacgctccccaagggcccctgtgagatacggtctggaatgggtccctgagcttccctgaggaccaggagtgcctacagggctcttccctgctgctgcttctacttttatattttactcagctctctaaatttatttcagctctaggtaaggttaaatccttctcccatgatctggattttcaggcttcctagtaaggatgtgtgttcactggcagactttccccctctcacaccttggacactcccagttttttggctatctctcagaatttgcagtggcaaaccacttctttcaaagggtctgaattcttttggttttcctagtatgtccctctggtatttcttggagcaaaagttcacagtgtaagtctccatacactgttctgtccagcttcagggatgatttttaagcagctatgagatgtagatgtacaaagttgtaattatttctttacagttgcacccaacttagttcacaagtgtttgtttgtactgatggagaaaagtgcatcttatcaatttaaaggaattcagttacttctgattttcaaaaatggttcatgtagggatttaaacagttaaaggtttcccacctcccagggatgatgcatagtcttagcttgctgacactgggtgaaggatatctgttcgcatcctgtacttgacccaccagcccactgagcagagctgcgctcctctcccttgggcttgtgtgtgatgacagtggatggtctgtggtcttgagatttacacagtccggattctccgaatatttaggcttctctgtggttattttatgatgtcttaggtcaggttgcctagaaacagactcagattcatttgcgttcaatttaacagggaatgccctaaagatcaatccccatgtgaagtagtgcaggaaagaggattgaacactgggtgtgataacaatagaggcctcaggggagttctgcagctgtcctgaattaaccccctttcgggcaaggtggagaggcctttataaccagcacctcctattggctggctactggaacagagttgggctcagggcaattccagagagacactcagcaaggagagccctcaaacaccaatactcccagcacctaaaaaatttagggcctcagttctgaaggagaactcaggatggcacagcacggcattcattgcagttagactcaattcatcagaactgtgcctttgcactctgctcgaacccttcaccaccctcagacccaaaccagggctaaggagctcttagcattcaggaattagtaactctatatgcatatctatctttatatgttacattaagtcttcttcactaagactgataaattcatgaggacaaatatttttgtttaaatcactttcaagtacccagtacctttatacattttactggtagcacataatagatttttattaaatatttaatctattaatacagaaatcttgttttcaatgttagctatgtaaatgctagtcagtggtgaggcagcactcaaattacctagcactttgtaaaaaacatctatttctgaatcctaaactagacctactgaaccagaatttccagggctgatcttagaaaaacaggtatatttgtaacaagctacctatttgagctacagtgcagcattgacccaagaaatttctactgggtttcagctttcatgactcctcacatattggaaataataattttcaattattgaatcgagtaatattcaattattcaaataaaggaaccaaagttcctttttatatcattgtcctccaaacaaaataatctttttcttagttttcttatttggttttctagttgtcgttccaacgtaaaagatttttttaaatgtaagaaaaaaatacataggtaaaaccgtatgggtgttccttaaatatgtatataattatatttgtcaattttacctcaatagtgctgaaaaaattaattactgagtgactagcaattttacttctatgtatatacatccaaaagaattgaaagcaggatctcaaaaagatttgtatatccatgtttatagcatcattagtcataatagccaagagggggaagcaatccaagtgtccatcagcagatgaatatgtaaataaaatgtggtatatacataaatgtaatatcattcagccttaaaaggaaggaaattctgtcgtctactacaacatggataaaccttaaagactttatttaagtgaaataaaccagccacaaaaagacaaatactacatgattccacttatgtgaggtatctacagcagtcacattcatataaagagaagggagaatggtgggtgtcaggaactggggggaagaggaaatgaagggttgatatttaatggatactgagtttcaagttttacaagatggaaatgttctggagattgcacaaccatgtgaacatgctaaacactactaaacttttacacttcagagggttaacatggtatattttaagttatgtgtattttaacaatataatttttttgaaattatgtaaagaaaatacaacccatattttagtttctgggcctgaaacctatttctgatggccaggtagtggctcacaagaaatagagggagtttgagccatgcattcaaactggatacatcacaagagcaatacaggttcaacacatcttcactaacattttgactaagattttaatctcttaggaatgacttgtcatctgtaagtagaagcaaacagagcccatatctgcaagaaggtggaggtcgtatactgatcattaaactcattaaaacgtggagtagctggaaagtagttataaaatgacttcctgggagccatgatttattctgcatcagtggtttctattgtcagtaagtgcttttaccaccagctcaacctggaatttaaaaagaaaactcctctaccttttagtttttaaactatatcctttctattgtcagaacattgacaattgtgtggataagatcagaatgagtcatctcagctcttctagttgaaatgactacaccaccataagagtttgttttttaacacttgatgctgagatttaaaatttctgagggaccaaatagagtacaaaaaatgtgtaatagcattttttattaacaatacaatcaatttccaggctaaattaaaagagcatgaaaaaattaaattcatagcttatccaaacctaattttgatattcatttcaaccattctattgatctaaaaatatagcaagttctggttgattcttttaaaaagatgcatagtcataggttcaataggtgattcctaaaggcaagcacagttattgaattttccaaaacagtctcaatgtcacatattctgccccagtatgctcacaaaggcttttaagactataaatcgtgctttctttttttttcaaattataaagttagagtcaccaaagggatcctggctatttattatacagtttctggactacaggaacatgaagtcttagagaaataatgataaataggaattcttgataatataattttttcatctatttttcttcttaattttgggggaaatgtttgagaaatgtctaaaaattagcaagccaaaatcaagaagttgaaggaaaagattctggataaataatttagcctaaaaataatgtgtggtcctgatttaattaattcttaagtatattgtttttaaggagaacagtacatattgtagattgaaggcttattcatttcacatttgtactagaactgttacatatgatgcaaactcttcctcatttttttagaatttagagaacggtgaagatgatgataggatttatgtgccatttctgcagagtataaaacattctcttattttaaattaaaatgatttaatttatttttggaacatctttttgattctttggtctcccaatattcaggtcagagatttagccataaaaatcaattttcgaattaataactcattataacttcttaatcgataacatttcaaattacctaaacaacttttgaaatctttagaaagtgacctaaatatgcatacatagaaaaataaatgcaattactgttcaatagtagaatataatggtagattatgtaattaaggtatagttattctgatatgattatcatgtttcagaaatattatttcattatcttagaagtcaatttgagtgtaggaaataaagacactaaggtttcattttctaaactattttcctatctgcaaaccaatgatgctgtgagggaaaggatattggaaagcatttacaatgcatggagaagagcacatagttacgaaactcagtgttgactatcatgaataaaagcaagtctcagggccattcacaacttaaattttattgttcgaagaatgtattttagaacttatatgtatatacacacacacacacacatacacccacacattgtcaactcctgcaaatatatatatataaatatgtttaaatataaatacaagtaatgtataaatatatattactttgtaaatatgcaagagagatatatatgtaagatatatttaagatatttatatatgatatatttaaaaattaatggtcactttccttgcagcagtgataaataagcatagaataatagaaattctattaaagcaaaaaagcaacagggctcaaaacaaagtcccatgtaactaactaccttgccttatctagtagttgaccaaccctcttcaccatcaatatggacactttattgccaaatgattgcttgtgtcatctcacatgaaaatcaattacctgaatgttttctttttctctttccttctttctttttttttttttaatttactttccaagggttgggggaggagtagggcatagttgcctatggattgcatggtttcttccactgacaaagacactttgtatctctgtcttgctctacattttacttaattgaaataggatagcagtatttaaagtaattttttataagtactgagcgaaatagattgaactgagttgatttgggttccttgccaatcttgactattcagacatcttttctttttgccttgcctctgcttttcttccttcctggtcaagtgaattttatatggttcagttcttgatgacctgtgaaacaaactaataaatctaatagctttagaaaatgtcacatgtagaaaatagaaacttcactctaatagtcctcctaaattatgatgctatcataaaaaaaaatagggcaagacttctccttgggccaaacttttcagtaaaaggattagctgataattatagtgcaaactcataaaagaaaaattatggcacttttcaggaatattttatttttaaagttattcattattaatagtaatatgtcgtacatgtatgagtgttataaatctaaagcaatttcagaaccattgtctcatttaaactgtacaacaacccactgtggcaggctttattattcttattttaaggaacccaatactaaagaagttaatgtcggtgtcaatactgcagcaaggacctgaacacaaatctcctgatacataatctattgttcattatagggctctgctgcattcttagtagcactgtgtcttacatttctgaaataattgtaatgtacaaaggataagttgttttattttattttatttttatacacagttctcactagacaactgttaatggaaattattccacataccaataaactttgcatcaatgtttatatccatttaaaatcatatatactgttattttgtgaacaagttgttttttgtttgctcatttattcattcattctttttttactcccttgggtacagcattttgagtcagtcttttcgttttttttttcaactggattaaaaatatttgaatacctatagaaagttgtttccattgaaaacatttcttattttcctctgtgaagaatgttgatgaataatcagagcttcatgttattagtaatatttatttcaaaattaaactgttttcttagggaggacaagtattttggtggctaaatgtttgagattcttatctgaaaactcaactaacatattctcatatctggtcatgttacatacagatccatttactatttcctttattgttaagtagtcaaagttactgttgaatgaatatattttgtagatgttctatttatctatatttacaaaaataaaacacacactaaagcagcaaagttgcaactttcaaaatgtcactttgagtaaatgttgcatcaagaacttgttagtcaaaaatagatttttccctaaataggtgtaaacaattaaaattgtgggagtttagaggaaaaagtgaaaagatgttttctttatttgcaagaatgtatattttctcagaattcatgtaatttcaagatagatattgctaaaaataaatattgatgataatatctgtaataatactatctacaaatggcacagactggagtataaataggttgcacattccattagtcattcactatttaaaatgagaatactaaactttaagacagtatctgttttgtcctacactgccattttttcattccttaaagacaatttgcaaatagcctttcagcacttgactgacagaaaaattcttctgacagttggtataaaacattttaccacaaacagaactttggcatctctagcacattgcagacatctgttacaatatgccataatttttagcacctcatcataaaggcaaatccagaactatgatctaaatataactagcatattttatatgggctttcctgctgtggactgccaattacgaagcatgagtaatgaaagaaggtaccctttagagcagccaattctcagaagcattagttttctttaatattctactttcattccaggaatgggcaagacaataagtaagacatttcatgtcacttcaggataatatcatgtaattttagggtaataaagaattcataagtgatcagataggagaaagttcatttacattctctccagagacttttatctcttcagatgtgaccttgtacaattaaatctatttcaaatatccagagaaatggcagctaagcagacaatggaatgcttcattttatgttggactgaaataaagtgaaattaaattatatgaaaacagtcaaatgtaataggagataaaaggttccactgaaattcttgctatctaatcttattcattagaattttctagaaggatgattatattgtgtgctacgtaacttgattttaaaactggcatttcattaatatccccccaaaaggactgaaattaagtgtcccagagagtcatttgtaaatgctattttaattcagataatttatataagcagttggactcaatatagagaatgtgtccttttaaaataaaacaggcttttaagaaaaaaatattttaagtctttgtgtcacaattgaaattttgattaaatctttaagaaagataattaaaaccatatctaatgtgtttttttaaagaaaactatttaaagggataccaagtgaattatataagaattacttttcacaataaaagtaattattaaaaggcacaaatgtaattttatcaggatacttttatatttgcattctcttagttgattattatctttaaacatttaacttctcttccattctctggttaccagcgataaaaagtgtattttaggccgggcttgtggcttacacgtgtaatcccagcactttgggaggctgaagggggcggatcacctgaggttgggatttcgagattagccttaccaacatagagaaaccctgtctctactaaaaatacaaaattagccaggtgtggtggcagatgcctgtaatcccagctactcaggaggctgaagcaggagaatcgcttgaacccaggaggcggagtttgcagtgagctgagattgcaccatcggactccagcctgggtaacgagtgaaactcagtcccccccccccccaaaaaaaaagtgtattttactgtaatcaatctaattatgaggatgagggttttcattcaatgttgatttattaccacgccatttgtcatttaaaaggtgttttcttaattcattgcattatttgacttttcttatgatatctaatacatacatagaaaagcatagaaattttgttctgtgtgcaactgagtaatttattacaaaccaaatgttcctgtaactactacctaggtcaggaaaatgatcacagtagcaccctaagtccctctcttgattgctctcaatagccaattcctgtcttccatcgtaaggtaaccactatcctgatgtttatcgtaataaattttgcttttatttataatttcaacacctaagcacacatctctaaacattttgtctctttgttggatttgcataaatagaattatatattactcttgttaagcattatgttgagggactcaggatgtactttgtttcattaatcttggttgttgtataatgttcgacaatatgaatatatcacaatgcatttatgcattctactgttcagtaacatccttaaacctgagcagacactcagacctggctgtgttttaaatgacaccactctgtctttccccaggctccccaaagactggaggaccaagataaaaggacagaatatacatttttagcactttatttatctatttatttattttgagacagagtctcactctgtcatctaggctggagtgcagtggctcgatctcggctcattgcaacctccacctcctgggctcaagttatcctcccacctcagcctcctgagtagctggaactacaggtgcacaccacctcacccagctgatttttgtattttttgtagagacatggttttgccatgttgcccaggctggtctcaaactcctggactcaagtgatctgcccgcctcagcctcccaaaatgctgggattacagtcatgagccactgcacattgcctgttttattgcattatttgtctttttctcattgatttttaaaaactctgtataggctggattgaagccttctgtaaactcttaagtgtcacaattatcttctcatgctccatttcttctctacactctcttaatggggtatttattttgcctatctttaaaaaaattgtcattgcaatgtataacatacctacacataacacacatacaaaagatatataactcaataatttattacaaaaagaactatcaggtaaacaacccaggtcaagaaatgggatattagtgcttcgaaggccctctcttgactgcttcaaaccattgactgttcctccctcaaaacaaccaccagtataagttctatggtaattgtatcctgaatatgtttatagttttactacgtaagcacatatgtctataatctatcatttagttttgtcttttttaaaactttatataaatgaagttcagtaaacattctattctgtggacacttttgctcagcatatgtttgtgaagtttatcattgcttttgtgagtagctatatttctttatttttatttttattttttgctcatttatttatttatttatttatttttgagacagagtctcactctgtcgcccaggctggagtgcagtggtgcagtcttggctcaccgcaacctccgcctccctagttcaagcgattctcctgcttcagcctcccgagtagctgggattacaggtatgcgccaccatgcccggctaatgtttttgtatttttagtaaagacagggtttcaccatattggccaggctggaagtgagtagctatatttcattctcattactgcatagcattccattgcatgaatacaacgcaacttagttgtcctttcttctgttcatagacacttgaatatcccggttcgtgaacgttataactagtgctgctaggaacatactcgtataagtctcagtacacacatgcacacatttcttcatgggaatcattacattttctgaatataagcctttgttaaatatatacggtgctaatatcttcttccagttttgtcttttttgacattctcttaacagtatcatttggtgacaaccaaaaaataaagttctaaaattgcaatgtggttaaataactaccttttcctctatggttagtatggttttatttgttctttttattaatctttctctacctgaaattcaggaaaataatttctatgttatgctttataagctttctggttttaccttacatatttatatccactatctagctgtcattgactttcaagtatgatatgaggtaggaatcaagtgctatattttttagtatggatatataattttttggaaccattgcttaaaagcctattaattcctattgctttgcagttacataaatcaattgtctatttctaaattctttattatattttgttgttatatttgtcttcctttgtaccaaaagcacacttataattgtcaaagctttataagaaatattgctgttggataggcaaatcctctcatttcttttcatggttaaaaaatatgttagctataaatggataatttgcattttcacacaaatgttttaggataagcttgtcaagtttcacaaaacctgtttggggagaattgacatctttgcaacattgaaccttctactcagtaaaagtggtattcctctatgcttatatcgtctttatcttttctcaacaatttttttttaaatttgtgtgtagagttcttgtacttcttttgctggatttgatggtattataaatggcgtggttttaaactttttttaatttcttaattatttgtctgtgaaatacaaacagacaatgaatttttatatattgagcttatatccagcatattacctccaatgattataatttatctatgggtcgggcacagtgactaacacttacaatcccagagctttgagaggccaaggcaggaggaccgtttgagcccagaagttcaaaactagcttgggcaaaaagtgagaccctcattatacaaaaaatcaaaaaattaggccgggtgtgctggcacgcacctgtggtcccagctacttgagaggctgaggtgggaggatggcttaagcccagaagttcaaggctgcagtgagccacgttcatgcctctgcactccagcctgggtgacagagcaagaccctgtcccaaaaaaataaaaataaacagaatgatggattgtttgagatttactggttatataaccatgccacctatgaataatgaaaatatattttatttctttattttaagttcttacatatttcatttatttttcctattcttattcacactgcccaggatctctagtgcaatgatgaattgaagtttaccttaatggtctgttgtgtgtgaattagtgatagttctctgcctgatgaaaattagaaattcaataactgattattttaaataataagtcctagtataaccttaaatgaatagcaaatgtccacttatagcttcctatttatatatttaagaggtatggaacaactttgagttgtaaaatatgtcatatttacttttcacttttgtttctaaataaaatcctggtgacctcactaaaaccattgattgtttcagcatcgctcactggagcttcttctctatcctcacggcttacagacaggacttttaacagccccattttataattgaagcccaactgacaaaattgagactcaggtaaatttaaaaatatctgcaaggtcacagatacgagtagcagagctcaagtcaagccctggcagtcaactccagtctttacttttcaatattatgacttgtttaatctccgactttatatttaaatatagcatctatatattcacataaaagtattagctaagcctgttagtatttctttagtggtttttaatctgtcttttcttttggctttcatgaaaagttcttaaccaaactccacacgatcatatggtgagataagagctgccagcagtgtgaaagtcaagcagaattgttatgtaatgttattaatcagaatcgtacttcttagatcctttacctgcctttgtcatattcatggaagtttatttcctcaccaccttcactttcttctttctaatccctatccttccacccaagaaaatctcccaccccccctgccctgaccttatccatgtgtactggttatgattttcataagctggcctgacaaggagtgacatttggcttcgctttagtgtaaaatgtcaccagaaaccagagctggtgctgcactatgttgataatgatggcccctggatgatacagtcactagagacagggttcattattttattttagttattttataagaattttgatggatatctagccctttttgctactgtgtaattacatacagtataaccacagatctggagtctagcattgtaagaacaacatgcaaggtaaatcaggtaattttaaagtaatttctttgcacctgaggtaaaggaagaatcataataagatcctaacaaagataacttttgcaactgaagtagatttgattttgctggtgatacatctcatatagaattctcatcctaccaagagccttacccttcatctgatggaatggctgattgtagacactgaccctaggttacagagaaaagagaattgctgattgccaccaacatattgaccagtttgtttaaaattattgtaagttataatgatataaatgacctggtaaagtctgaaatacccgtaaaagatatgtagctatggccaggagaagactgtagatgcttacttagcaaagtgaatggcgatatcttcatgatgattctgaatgccctctgtgaaatagcccttcttcctttccataggatggattgtctatgcagtgtctgccaacacattataccactttgcatataaccaggtttcacgttgcttttaggaaccctcttgcccttaagagcctattgcagtgctttagtcttggacacataagatcaatgcacttacaagtatgatttaataagatactgtggcaaacccaaagcagaattcactgcctctcttcctttaacttatcccttttttgtgtgtttgaatgagtttcaggcttttccatgaggttgaaacattatatatttttgttatgttccacacattatatgtgtgaacccattatgtgttgggaatgatatctctatcattaatagtttagcttggaactcaatgttcatagatttctagttactttaaaaaagctgctagttattaaaatttacaacttttatcaactatagttatatataattttatttattgaagttaacttaaaactaaaattgtacttattaattaaagaatttacagatagtaacttaattctgaaagtacagagtattcaatcaactacaatattctgaggtctggttcatcattactagaaatcttttaatttcacagttcaaaaagaataaaacattttctgatctttgacttctagaccaacactaagaaaattgaatttgaacttgctataatttctagaattcagctcctagttgctggcatgagaatgtggggaagtataaaagatgacacaatatcaaaatacatttggcttgctagaaataaaatatatatatatatatatatatatatatatatatatatatatatatggttattttttagatagagccttgctctgtcacccaggctggagtgcagtggcatgatctcggctcactgcaacctctgcctcccaggttcaagtgattctcctgcctcagcctcccaagtagctgggactacaggcacctgccaccacgcccggctaattttttatatttttataacaccatgttagccaggatggtctcgatctcctgaccttgtgatccgcccaccttggcatcccaaagtctgggattacaggcatgagccactgcacctggccttatattttttagttaaataatttgctaagcaatcaacaacttttagaagcttaaatgtttctagaattagaaacacttttttgacttttaagacattttttacccttaatcaaacaatattttgtttcataagattattgtgttcttcatcataaggattagtataaatcatattatgttcaatgtactatgccaggcacttttgcatacattatatttttcatcacaaggatccttcctgtacatattctcttattcctattgtgcagatgaggaaactgcttcagagactttgttttcccaaaggcatatatatatatgtgtgtgtatatttatacatatgtgtgtatatatatatatatacacacacacacacacatatatatatatatcaagtagcagtacaagcaggatctgaacccatattttaaattttaagtctaatgagctttcaactatattatatttggatattaatgtaaataactggtaaacaagcatttctttagtgcctactgggtgataatgtcttgattaaggaaatagaaagttaaattatattctagctgaaaatataatctaaagaaacagccttgcaaattgaaagattttttttaaaaactggtaatacattttactggtttaatttagatatttattaatgacattttctgtgttaattgattggccaatattacatttattttctatactactttaggtcttgaaactgctaaatagtaatcagtaatgtaatattgatggcatcgtactcttcctttccactctgtgtgatgcttactagttttatttttttaataaatgaggtgggtgtgtgtatgtgtgcaatatcatagaatgttttgatagcatttttttcctgcagaatatatcctccagtaattaactttctaaaataaacacctgtaccataagaaatttaagaatttctcatgtttttgtcttatgtgtattatatctgcaggaagatgtagcataaatgcaaagttggagtacctaatttgtttgttgttgttgttgttgttgttgttgttgttgagatggagtcttgctcttgtcacccaggatggagtgtaatggtgtgatctcagctcactgcaatgtctgcctcttgggctcaagtgattctcctgcctcagcctcccaagtagctgggattacaggcgtgcaccaccacatctggctaatttatttttattttatttatttatttatttatttatttatttatttatctatttatttattgtatttttagtagagacaggatttcaccatgctggcaaggctggtcttgaactcctgacctcaggtgatccacccatctcaacctcccaaagtgctgggattacaggcatgagccaccacgcctggccccctaattcattttatatcctgaattattgagttagagaagctagaaggacatctggatttcccattttaaattcttctataagcctagagctcactgaaaactcgaagctaccaacctttatgactgtctacttcccttacccacattgatattccaaaattaaaagcaccttcccaagctaagatacctagtcgataatttgtctcttccttaaattaatttttaaacactcagcccttttcagatcatctacacatgaaatgcttctttctttttagcaaaatattctatatagagactaaagggaaatgctactcgcctaccttctctgttcctggatattctgattccatgtcaagtattcagatataatcttatttttattaatattaatctacacaattaagcagttcttggcttttgaataagacaaactaatgttttacatgctactctacctcttgttatccctaaattctttaagaggttactttacctctctgaaccacagctgtcttgttaatcaggatagtagtgttccctcacagagggtcagaagattgaatattcaaggcacacttaaattattttgattataagcatcagtagttccttgtggttgataataattttgcatatgtgaatgatcttatatttgtttatttttcttctctaaggaaaagtgatacaatggaaatacaagaaataaaaaatatttgataactttagtacatacaaatagaaataacattggtgattttatggaaaaatgttttttattgtcacaataatttttagcttgtcaaaggaaaataagatgtcagacaacttacagaattattctgattgtaaacaatgttcacagacagtctagacgtctataattgtactcgccgtgtgttataagcaagaatcacctgaatgtagattttataatgaaaaaaattatcacaatttctgatacaggaagctcttggtttgtctgcatcaagcacttaaattggtttgtatttagatcacaccaattaccactaatagagttaaaatactggaagagcccagaaatggcagaagaccttgataggtttttagaaagtccattatatttcagtgagaattctgtttctcggggaaactacttactgcagctgtctgagactaattcattcttcatctctgtgtggagctacagtgtgcagcaaaaagtggctcatgcaagagtaaatgaaaaggcttaaaacaatttgcatgggctgtctcaaaagaactgaaaaggtgatgggcagaattaaaaactagaattttctccaagctttttaaccattgagagaaatgcctaaaagcaggacattttatatcacttgtcctacccagtgcaaatggaaaatgcagtacttcttgttcaaacagctgacacgtcccctgaccgcgtttccttcccagctgtcagctgctggattgattcactgggacccagccagtggggtcttctcttcccacagttcaccactggaaaccactacacatggacaaccctcaaaaattgcaacctcttctccaggatgctcttaatacctgcatctggagtgggcaagaggtttgtccctgccaagtcgaccacaaaatgcatggtaatgctgctggctgaggggagagagggtggccactgccatgcttcactctgagctgccatggggcgtgcacactctactccacacctttccatgcctaggctcagcagtagttgctgggcaagggtgtggagggtaaggccaggtgggagaaggggtgagagagctggctgctgaaaacccatcaagggtatttatcaggaggtgccccacgcatggtccaagacaccaaagtgttcacccaagcttctcttacaaaacataaattcaaagataaagttattaagagtttctggacagcaaccacagagcattaaactccaagaatgggtgggagtaggtttcttctgagatggattcttgtgcggctgacgtgggtagattcccttggagccagccatgaccagaagggtccatttgcatgtgcaaatgattgacaggttatgtatgagttggattgatacactgaagtccaaacacccagtactcgtgaatgtaacctttggaaataggatctttgcagatgtaatacagttaagaagaggttactaaggtgggtcctaatgtacttataaggactggtatccttataagaagagagacagacacacaggacaaattccatgtgatgatagaagcagagattgactagacacaagccaaggagtaccaaggattgccagcaacagcagaagcaaagaaaaaggcatggaatagattttcctaaagacttcaaaaagagtatggccctgctgacaccttgagtttggagttctagtctccagaattgtgagacaatcataagtctctgttcttctaagccatccagtttttagtaatttgttactgcagccacaggaaaactagtacaggtaatattttctctatcaatcattcttttccacaaataatcatgtatttttggtttagattcatattaacctttcttggagttaatccttaaaggcaaatttgaagtttcaagtagttacttcatgtttgaacttaattatttatagtcacttttgtgagttttaggtagtggacttatgttcagaaacataaggaaatgtaaatatatacagtatatctccatggctttgtttttgtgttttggcatcttatttacaccacaagtggcagagtggttaattgcactagataagttgaactcttaacggacagacttaaattatggactacttaaaaagaaaaggggaagagattgcataatattgttattcaagccaaaaagaaaaaacagtcttgaaagcaagagtgaatgaaaaagctgaaatgaattgaatatcactgtttaaaaacattacatttttgtagaattttttttttttttttgagatggagtcttgctgtgttgccaggcttcaatgcagtggtatgatctcggcttaccacaacctccacctcctgggttcaagcaattctcctgcctcagcctcctgagtagcagggattacaggcacacaccaccatgcctggctaattttttgtattttcagtagagatggggttttaccatgttggccaggctggtcttgaactcctgacctcaggtgatccacccacgtcagcatcccaaagtgctgagattacaggcgtgagccgccgtgcccggccagaattttttttttttttttttttttttttgagatggagtctcgctctgtcgcccaggctggagtgcagtggtgtgatcttggcttactgcaacctccgcctccccagttcaagcgattcttctgcctcagcctcctgagtagctgggactacaggtgaacgccaccacgcctggctaaattttgtatttttagtagagacagggtttcaccatattggtcaggctggtcttgaactccttacttcatgatccacccgcctcagcctccaagtgtgctgggattacaggcttgaaccaccacactcgccagtaataaattgttttagatgtctttattttaaagaataaattaaggctcagagtttaagcacaaggcccaagtcacagactaaactataagttaggtcatcaggtgcctggttgaagctttttctatttcctcatggaaatgatgttataggaaaaattccaagatcccaagagattataactaacatgacttcatgtatatattcaaaatggaataatgtaaaatattaatttctaccacactgagaattacctgagattcattctaccttcattttgtagattcaaaatatggtgattttgcagtgatcttggtcttaatttgtgttcttccagaaacagatcctgagacaagaatttaaatgtaattagtttagatgggagatataggaaatactagtagggctgtggaagaagtgattccaaggaggcaggctacaaataaagggtataatgtgaagccagccaccacggggaaatgattggaacgtttcctgtgaggaactgcaaaaacagagctcagagttctcttcacccaatgggtgcgaagctgggattgttaaacaccaactcccagcaagtattactggaagctgctggggcagaagtgttaatgtctcagcacttcaggcctctcctgcttatagaaagagtggccttctacattgctagaaaatcccttacacacagtcatgcagatactcacagttgaaagtccacagaagcaatcatattttaagattccaggaatatgtgtgggcactgtcagaatctgcctcatcttgaaattttattttctgtgaaagcagcaaatctggaaagcaactaaaaacatgctactcaaagaaattgactctatttagaataagtggtatgtcttttttctgtaatgaatatattaaacattatcatttgagatgaaatatgtaattctcaattttacctaaatgagaaatttttttttttgacggagtctcactctattgcctaggttggagttcagtggcatgatcttggctcactgcaacctccgcctcctgggttcaaacaattctcctgcctcagcctcctgagtagctgggattacaggtgtgcaccaccatgccggctaatttttttagttttagtagaaacagggtttcaccatgctggtcaggctggtctcgaactcctgacttcttgatctgcccacctcggcctcccaaagtactgggattacaggcgtgagccaccgtgcctggcctctaaatgacagatttgaagatttacaaacctgaaaataattgtagaaattcagtctaatactcacacttaatagatgaagaaatggagattgaaaaaagtgaagtgatttgtataaggccatctatatagtcagtggagttcatgggtttaaagttttagaagacaagagctaaacacgacattcaagggcaatttatatctgaaaaacaacttccatgtttagactcacattttaataaattaatcaattcatttctgtttcctacattaaaacatttttcacagtaaggaaggttaatagacctgaaacaatagtattaaaatcaaaaccatatgatggaggaatatatggactcaaatttataagcttatgtcttcataaatataataatggatgcattatgatgaagaatcatctttgcattggtaatagaaaaacagtttattcattccagtgattctgccagtcagaattcatctttggaactagcccaaaatttctgcaataaataaataaataaatgaactcattgcttcagagccacaccatgtttttcactgagaaaattgcattagccaggttgaacatctattttccagcgacttaacaacgaattacttttagttgtggccaaaattccaatctatttcaaaagattatttttcatcactgacaatattaaaaagaatatgcctttgaacaataaccacatcattacattaaaccacagttccccgaagtaactattttagagaagataatacacaatacacattaagatatgtacatctcagtacattcatttttaaatgtgtcactgtatactaatagattatgatagaccataatagataggtctaggaaaggagtagctcaaggagaaattcacagaatgttcttggaaagcttcaacatccatggaatattcatagaaggctttatggacaggtggctttcaggttgggccctacaagtgtaatagattttgatttatcaatgaggttatatatattttggtttactactgatatggtttggttgtgtccccacccaaatttcatcttgaactctagttcccataaacccaagtgtcatgggaaggacccagtgggtggtaattaaatcatggtggtggttaccttcatgctgttctcatgatagtgagttctcatgagatctgatggttttataaggagcttttctcccgcttcgctctgcacttctctcttgccttttgcaatgtaagacatgtcttgttccttttcaccttctcccattactatgatgcctccccagctatgtggatctgagtccactaaacctctttttcattataaattacccagtctctggtatgttcttatagcagcatgagaacaaactaataaagtaaattggaccaggtagtggggtgctgctgtaaagatacccaaaaatgtgcaagcaactttggaattaggtaacaatcagaggttggaacagtttggagggctcagaagacagaaagatgtgggaaagtttggaacttcctagagacttgtttaatggctttgaccaaaatgctgatagtgatataaacaataaagtctgggctgaggtgatatcagatggagatgaggaatgttttgggaagtggaataaaggtgactcttgctatgttttagcaaagagaatagcagcattttgcccctgtcctagagatctgtggaactttgaacttgggagacatgatttagggtatctggcagaagaaatttctaagcagcaaagcattcaagaggtaacttgggtgcttttaaaagcatttacttttattcattcacaaagatatggttggaattggaacttatgtttaaaagggaagcaaaacacaacagtttgaaaaatttgcagcctgatgatgtgatagaaaagaaaaacctattttctggggagaaattcaagccagcagcagaaatttgcataattaatgaggagccaaatgctaatcaccaagacaatggggaaaatgtcagtgtgacctggatgtgagacatggagtcaaaggagatcatttggaattttaagatttaatgactgccctattgaatttcagacttgcatgggacttgtagcccctttgttttggccaatttctcccatttggaatgggtgcatttacccaatgcttgtacccccattatatttgggaagtaactggcttgcttttggttttacaggctaataggtggaagggacttgcctcatctcaaatgagagtttgtatttggacttttgagttaatgctggaatgaatgagactttggaggactgttgggaaggcacgattgtgttttgaaatgtgaggacatgagatttcggaggggccagggtggaatgatacagtttggctgtgtccctacccaaatctcatcttgaactgtagttctcataattcccacatgttgtgggagggaactggtgggaggttattgaatcatgggagtggttacctccatgctgttctcatgatagtgagtgagtttcacaaggtctgatggttttataaggggctcccccaagctttggtgtgcacttctctcttgcctgccaccaggtaacatgtgcctttgctccttcttcaccttccaccatgattgtgaggcctccctggcccagccatgtagaactgtgagtcctctaaagctctttttctttataaattatctagtcttgggtgtgtccttatagcagcatgagaacagactaatacaattagtgatatattgtgtgtttgtctaagtttttttttatatttgtgttattatataagatttgagatttgtagtaaaccacatgcatagaagagttctaaaaaaagaagaaaagaataaaaacagtctgaatatataaagggtgttgcagcctagagaataatggaaatcaaagtatataaatctagtgaaaccaagataacagaagattttgacaactactcagaagtaatcaggcataagcgataaagtgccattgaacacattagagaatattttacagaatgcctcagcgaaacacttggttaggaaatgctctatgaacttatttggaggtgaggagaatagtcacctccccaagactgttggggttacaagactgttgcaggggtacagattattaagcaccaaggtgagggttgcagcaatagagatgagagtagaaaaaatatgaaagaccatatactttcaaggagaaatgattaagatttcatcattggctgtatatacacagacatcagagaagaggtaaaatgaacttcaagatttcaaaccatggccaggcatggtggctcaggcctgtaatcccagcactttgggagactgaggtgggcagatcatgaggtcaggagatcgagaccatcctggctaacatggtgaaaccctgtctatactaaaaatacaaaaaaattagccaggcgtggtggcggtgcctgtagtcccatctactagggaggctgaggcaggagaatggcgtgaacccaggaagcagagcttgcaaagagccaagattgcgccactgcactccagcctgggtgacagagtgagactccatctcaaaaaaacaaaacaaaacaaaacaaaaaaatagatttcaaaccataatgagaagaggccactttccctgatggagaacaacatgaagcaatgaatgctgggtgggagaaaacatctctttaatgtaatttagaaatatcagtgaaataatttaaagaataggtatttaataccattggtttctgctcaaagttccaaaaagatatagatgaaaaaaacttcaaatagatgagagtaaggtccagaactcaaagtataaatagaagtataacattttacttctaagaatgggactaaaaataaaggcattctagaaacttgctgaattttggggagactataatttatataaatgacataaagagtcatagaagtgacaaacagccagagatatcgttatatgaacagaaaccaatgaaagccctctcagaggcaacacaagatgaagtagaattagaagtgtaatccaaggagaaatttaaaatttaaagggaaaggactcaaaagaaaaagaaactgaacattagctgaacaattagatgccaacctccttatattcactggaagaatgtcatcagagtcagtaaaataatatgatggaagaaaaaatataagatttgtttttcctagttggagaatcttgggctaggataaatggcctgggaatctccaactaggaaaaatgtacatgaattttttttgtgttcttttcctagggtacttttttatcattgcaacatatccccatcaacttcaccatcatctatgaatatgtgtgatcattattagcatcaccgttagcgttgtgatcacttagaagacattgtggttgtcatcagcagcagcaataaatttatttctatagtcctgttactaaatttacataaactattgttaccaggcaataaagtaaggtggagctgaatgaattttttatgtttcaactttctgtttctcatcactcagtataattcttcctgccaatcttggaaagacctttccctccactgaaggggggaagatatgtctctctttttctatttccacattttcaactgtgtatcagtttgtaacaataaaactgcagggggaatggaatgcatagctggggagaactggacagggagtgaaaagaccatattagcccaactcagccaaattgcataacctttcttaaatcatttaacttttcagattgttaggaaatcagacctttcaatctctagagttctttctaattcttaaattttatgaagctagttgaactggcttgtcatgggcagaattatatatattgtttggtatgattgccataatattgataatgaagccatatcatgctaacaatattccagacattggttaatgtgccacatatatatatgagatttcatatatatatgattatacatatgattatatatatatatatatatatatatatatataaaaaatctcatttaattttcatgatgtccttataagctaggctgtcagtgtccccattatagacatgaataaacttggggttagaaactttaggtgacctgtcaaaggtcatacagctagcagtgacagagctttctttctttcttttttttttttttttttgagagagtgtcttgctctgtcaccaggctggaatgcaatagtgcgatctcagcccactgcaacctctgcctcccaggttcaagtgattcccctgcctcagcctcccgagtagctgggactacaggcgtatgccaccaggcctggctaattttttgtattttagtagacacggggtttcaccattttggcctcgatctcctgacctcattatccgcccacctgggcctcccagagtgctgggatttcaggcatgagccactgcacccggcctggagctttcatttaaactcagtcagctgagcacctgtgcatgatagtaaacactgtgctgttgttgggtaaagatgattaaaaacaaaatcttctcctattaatgcaaaaaataaaaataaataaataaataaaaaatattgtaaagaggtttattctgagccaatatgagcaactgcatcctggagaaaaatacaaatccaagaagccttgactaagtggccccgaggtggttgggttacagttttggttttatatattttagggagacaggatttacaggcaaagacataaatcgatacatggaaggtatacattgggttcagcccaaaaaggtgccacatctggaactggacacttacaagtcataggtgggttttaaggattctttatttgaaaattggttgggagagttaagctattatctaaagacctgaagtcaatagaaaggaatgcttgagctaagataaagggattatgggagccaaggcccttgttatatagatgaagcctcataggaagcggaccagcagaaagaataaacagaaaatgtctgtttttagagtttgaaaggtatgagattctcaaataatgtctcctagatctaggaaaggcctagaaacggaaggcctggctacattaatggagattctcaacagatgcaaatttccctcacaaaagacagctttgcagggtcatttcaaaatctgtcaaagaaagatattttggcctaaaatattttgatgtccttcagggtctactgtctgtcttttgatgctataccagtcagtttggaaggtaagccatattataccaggttaattttttgaaaaccctgtttaatgagattttatagtttgtagggtacaacttaaacctggccttgcatagccttaggtcttgtttataatttggtaccttaatgccacaaatcatatgttttgttagtcttatgatctctattttactattaatgctgctcagttgtgcttaaactcaaaaagggagggagtataactattattggcagaacatatgagagtcacgcagcacctaaataggttcctggtggtgaatctgtatgggtctgcagaaacctcaatccttgcctcctcagaagaaagaattcaactagggcataagacagagtgagagatcacggcaagttttaaagcaggagtgaaagtttatcagaaagctttacagcagaaaagaaagtaagataaacttggaagagggctgagtaggcaacttgagaggccaagtaaggcaacttgagggatcaagtgcacatttggaccttttgacttaaggttttatacgtagatatgcttcttcccttggggtggactgtccgcatgagcggtggccctgctaggatttgagagggccacatgagcagtgtgtttaccgaagttgtatgcatgctcacttgaggcattcttcccttgccagttgaatgctccttgaaggtcatatacctgttaaactccaccattttgccttttagtgcacatgcttgagcccactcgcccaaatcctgagaccttatcaggaagctgctgattaccagtttcagattattttctactgggagactgctcttccctggctctggctgggaccaattattattagtgaagcagctacattgtctgaggtatataccctggggttcgttgtcccagtcaggaaaatgtaggacatggacacacaggaggagtttaggagtagagctttaacagggagaagagaagagaaagagaaacagctttatagagaaagggatctccaagcagaaaggaccggctggcggcagatgtgccaaattttatagtcaggtttgaggaggcggtgtcttatttaagtagagctcacatattggttcaatcaggtatgacgtttacatagcgcccggggaaggctggtcgccccattctaatcttattatgcacacaggctttccagttgatcgctgccatcttcaaaatgtctaggccctagttcctgccggcattcacccgtgcaagctcccagcttgcttgtctgtctgcagcttgactttacagggcgttctttgttagaaaatgatttggggctgcttttcattaaagagaaaagacttaccgaggactcctatacccttaccatctgcctaagtgatttcttcttaactcttgtatcatcaggaccgcctgaccaccatctgatgatcgcttgacattcctggtgggggaggggagccctctgctaccctgctcatgcctgactagctacatactctaacataatgaggcatttcagacctccctgcctatcatggcgagaactttgtttttcgggtttctctggggtccccttggccaaggtgggggttctgttcagtcagttgtgggacttaggattttgttttcagttacattcccaacccagaaaacttttccacaaaggtagaaagaaacagctgtgctggccgggcgcagtggctcacacctgtaatcccagcactttgggaggcgcaggcgggtggatcacaaggtcatgagttagagaccagcctggccaatgtggtgaaaccctgtctctactaaaaaaaaaaatacaaaaattagccgggcgtggtggcacgtgcctgtaatctcagctactcgggaggctgagacagaagaattgtttgaacccgggaggcggaggttgcagtgagctgagattgtgccactgcactccagcctggtgacagagcgagactccatcgcaaaagaaaaggaacagctgtgctatataaaaatcattaaaccggaatgcgatttgcatcacagggaattctttaaaaagatttcaaagtcaacaagaaatcccacccttttctatagccagcaaacacaaccaattacgtgcacatgctcaggataaaaaataagtggtcctcaagaagacttgacagcacaatttgtcacacatagttcatcctaaatttacctgctgattgggttgtaagctaattggctttatccaaaagctaagtaaacttttcattgtttctgtcatagaaggtggttttggtgcccaacattttaggctcctgtgcgcccatgcaaactggaagataggggcgctgtcttccttgatgactgcattttaaagagctggctcccaggcccttgataagtcattcctgagttttaaagcttcctgggtcgtagagacttagctttagcttttaaaatgatttaaataaatttcaaagcgacagagaaagaactcagaatcacaagttttcaaaagtaaatggtttgagaaaacagagacagggtaagatgagggtagtttcaagggagtctcttttcttcaacagggagaattaagtgaactgtttttcatctgcatttgcccttccgctatctgtactgccaatactggaaatgcagaaattatataggagtatgctacctctttgcctttctgttaaaaggatcttctaatgaagatgttgaagatgaagataatgcaatgcttgcacaatactattactttacattctggagtgttattcaggtatcaaagggctagtttgtataaaaatttattggctcctcacaacaaccctatgaaatagatacaactaccttccctttgatatcatttgtacccattatgatgcaaaaatagagaagtaaagacatgcccgagaggtggagccaggagttcaactcaaggagatcgatttcttagttccaataagctgcttccacagttgccagtttctctggtggctacagaaagctgttgtgccacttggctcacaggaccagatcctggtataggtttttttcctcaacagcctgtatctgtggagtatatgaagccagatttagatccatttccatgtctccttgcctctttcccttcctgtcttctctggttttcctggtctcaggaaacacaatatactaatttcatgccatgattttacttacacaagattggcttcgtggttccacatctctgctatgagttgtggttctcaagggtcctgtttatcttctttgactctcccaatccaaacttcctacccattataaatattctcatctgccacctgctacagtcctcatccaaactctcctgttaacctgcacagtggggaggtatgctggaagaaaagaacaattaaataaacaaatagggtcactttttaagcagcagtttacattccttccttctcctttcatacatatatattatttgtcttcctcttcttctaaggagaagagggcttaaggaaaatacaattactttttttctctagaggattcttttggtatttaaaataaagttctggtatttcaaatgaagtgggaatacttttgctttcctagcatgaacagttcttaatgactcttcaaacatttcacctctaccatatgtacagtatgaaggtaagagataactgtggaattgtatgtgtgaagaaataaaatctcaattgcatatacatagagacctgtgaaatctaactagccatctgtttcatactactcaagagattctagagtttcttacattcctcagattttgatttatgtttattgaatcatgaattatacttctgcaaattatcccaggtttttcccaatgcttatatcagtgaatatatagtcacagagggaaactagagatttatgcatgcttgtatggtctactgttaagatatatgtgacatcttaaactttgctactttgctcctccagtggataattttaaaaattcttgcatattggtaacatgatttataataattttagttctaagaaataagtatttaatggacaacacagacattactaaatgtataatggggtgggggggtaactaaggccccagaggtaatatgatatggctacagcagttcagagttcccgaagctagaaaattgccttatttctctactttataatttctttcactctgtaagagctgtgaagaaaaaaggtgaagatccgtgggtaagagaacgtgagtgaatttcagtgttgctaactatagcaccagaaaatagacatttgaaaagctcagccactcctcacttcaatccaccttccacacggttaccaaattatcttcctgattaaccaccgtggttctgttgcatcccagaatccttgtgtggatttctatagcctgtacaatgaggtcctaagcaagcatggaatggcaagccttctaaaattcttcccttatccttctggcacttaaaacactgccttttcactgtaatcatttgccctctgtttatttcccctgtttagtttaaacacttgggaagcaggacctgctcagatccagcatggtgccagcacgttgtaggcctttgctaaaagcatggtgaatggatgaatgaataaatcagtgagtcgatttatatactgacttttattaactatgacagatgtataataaaagctttttccctaaactgtttaaggagatgcctgtggcctatatattgagtgacagaagggccaacctttttggtaacaaactaggcaaaagaatgagacaagatatgcaacttactcgtttagaataggcttattacaatagcaatcatgaaaaaaataatagtgcttacttactatttattaagtgcctacaatgtgctaaggtgttattttgaatgttttaaatacatgtgtatatataaatatgtatgtatacacagacttctgcacacacatgtacataatgccacaacactatggggaaagaggtatagtctgcattttatggatgacaaaaccgagtctcccagaagttaaataacttactcacccattaccactcgggagagaagaaatttttaatgtgataaaattagtaagttcacatgccataacagagctgtgttttaccagaggacagatttacttatctatttaacaacttttattgaggtcctacagtattctagcagctatgctagttgaagggatatgatgttgacaaaatagtgatcaaatttctacctgcacaatgttgactattcccatgatagttatactaaaagtccagactctaccactatgcaatatatgcaagaaatctgcacttataccctctaaatctataaaaaataataaataaatacacaagtttaaaaaaaaaaaagactgctatacctgcaaaaatcactgggacttagagtagccatgattgtttcttcttgccttccaaccatgataagtagacctggaaaaggactgtcttctaggagtagatgccatccgtatctctctttcttttccatttcctttacacatgccacttctttgctaagttaaacaagatgtgatttgcaaaaccgagtcccttagattcaagtgtgttagaagcaggaggcttcattttggactcagggccttattagagtttttcaactccgctttatatatatatacgtatatatacgtatatatatacgtatatgtataattgtaaaatatacacaacattaaatgtatcttctcaataatttttaagcgtacagttcagtggcattaagcacactcacattgttgtgcagtcatcacccatccgtgaccagagctcttttcatgttgtgaaactgaaactctatgcgttcaacaatagctccccaagctcactttcccccagctcctggcagccaccattctaccctcggtctctaagaatttgactactctacttatcaacaaaactattataggaaagtcatctgtcagtgaacactagtggtttatttggctgttgtcaaatctttgagatgtttcccattgggaatcagttgcctcaaaggggtgggaggtgtgagcagtggttagaatgcaggccttgaaggtgggtccctgcctataatgccatcatcatagcaccagaatggaaactctgattccataccaatattgatagaattggtttcagacctatcagactgatgcaagccagggcttgagtcaatataaagttgtcttcttttggggtgctcatctattttgagcagatttttcttgaataagcccaatttgatcttcaaaagaccaacccttctgccactctctgtgggccacaggcacactcccaaagaatatatagctgggggagggaagcatattttaattatgaagtcgacccaaagcatatatatgcattgattcattgatttcttttttatacctgcaacaccatgtgaaaagttcatgagtaactcagcaacctttagatcattttttttcctcctgaagacaatctcacttacttcctcttattctctagaactaatgatgtgacctgatctctttatgacattttttattaaatttaactataaaaatttcaaatgttaatggctgtgaccctgtagatttttctctccttcacaacgctgatagaaatgtaacttttcattcagggaatctatatttctgctctgcctctcagtgtttaagccagctgcccactgtgctaagtcaaccttcccagaagctaatctgtcattctcaagtggccttgcttctgaaattggtttgatgctctagcagtaaagagccccagtggtagtgcaagctgtacagtttaacaaccacttggggtggggcttgtccgattgccatggaaactatgactttgtatgtctgctctggagacaagaaagacaaatgacttgtgtattaatctattgaggatgtgaggatcccagataaaatgagtcctacagaacacggagaaggttctataaattaatggtgtgggtttttgggttttggttttaggttttaatatgtcgatgtcaatgaagggtcaaaagaattatgtctccacctgatagctttcctggagaagtatttgctttatatttttataaaaactctttgattttagccataaatgtaaaagataaacataacattctgcaagaccttcaccactccaggtgatatgtggctgttgaaggaaggtactgcacatttacataacaaaatgaggctattaggggacaagtcacttgtttatttaagagaacgaagggcaggacaattatattaacatgattctcataggaatgcacattgtcaatgttaacaaatggttttaagctaaagcccccggtacatggtatgtggtttaattttagttgtataaacattagagcaatctaaagtttaaattacattttggttatactttagactccattatccaggaaaatgtaattttagcctctataaatatgaacaaaaatcaaatctaatgattgctttcatatttataacatcctttcctaagttcacattgcccagctaagacaacacagtagaacaaatgtaaagagcaactaattagatcttacccattttccagtttatgtttagatttagtcttctaagtgttttcagaaagtagtatcagaaaaatgtaaacaacaaaaaactgaagatctctgcatctttttgtatgtatatgtttttccaataaaatgtaaataataatcaggatttttttcaggccccttttaaaacaatattttatgttataaaatcttaatgttgtttctctattatttcaatcactatttaagtagatactgaagtactaggtaaatgtttttgttttgtttgttatttatattgtattttaatttttaagccaatattattgaaatataattttccctttgagatgtatagttccaggaatttcgaccaatgcccatagtcatgtatccagcaacattaacatatggaatatttgcatggtgccaaaatgtttctttgtgcctctttgtagtcaattccttttcccaactcccagtccctggcaataacttgcatcgtttttatctttggctgttattgaagggagtgttgtggtcagtagattgcaggcctggaaagtagcatataggagagcacataaatgatttttgtatcctacatttttctgacactcttaccacattgtactgcaaagcagtttaaacttcctaaccctagtttctctaggagactgcctactgcctaacgtgtgccttttgacctaacttcacttgtgttaccttacgcatgtcatttaactttgttgtcattatcttatatgagatcaattactaagtgatatctacaatttaaaagtgtttaattttaatttaatgtagaatctaatttttaaaggaaattctaaaagttgtgtaggttgtttttcctctacctaccacaatgcaatttaaaaaaaaaaataacaaaatgttgcttattttctttgtgtcttcatctccaaaatgttctcttcacagtaatgcacacaagctagttctgagtaatcaattttttaaacaatattacaaatctatttttaagtacaaaagtattgtaattgggctaaaaaacaaatagcacactgtaaatgctaaaaatcaaagtgcctgtctcaccctttcttaccttccacccctagacgatacaaatgttaagagttcaacaagcattctgccagcctttccgtttataaataacatttttaaataaaaacaatgcaaaaatgagagagaaatctataaattgctgtttatcacaaatatctttccgtgtcagtaatataacttcctttattctccactggatagttttccacagtaaagtttcatcataattaacattgaagcagtgatgaacatgcagtttgcttcaattttttctcatatgtatatcttgcatatatttatcacaaatatacatatatttttctcatatatacatatatagttgtacaattacatgactatttcttatagtaaagatttcaggaggtaagattgttgggacaaattatctgtgcatttgaaatgttgatagcactatccaattgccatccaaaacgaatattcattatactcccattgatagtgtgagagttcccgctttctcataccctcaccacaaaggatatcatcaattcttttaattatagtcagtctgatagggaaaatatagtgcatcattgttatttaaagttatagtttcctcattagtgagtttgagcatctgtttagaagtttgttagagatttatatttactcttctgtgaaggttcaggatatagtcagtgcctggttatgttgcttgggttgtcagtctttttaccattgatgtgaaggatcactttgcattttaggcaaattagctctaaattttaaactgcaaattgcaatttaaaatttattttattttattttattttagagacaggatcttgctctatcactcaggctggaatgcagtagtgtgattatagttcactgcagcctcaaactcctgggctccagccatcccccagcctcagcctctcatgtaggcagcactacgggtgtgcatcaccatgcccagctcattgcaaatattttctctgaatttacctttatctttaactttattcaagtatcaaagactgaattgttcatgttttttcaagaatagtggttcccaaatcatctacagattaggtttaccaaggagcttttataaaaagactacagtctgagcccccacatatttaggtttaattgactgaggtgacattgaaacatagtcccgcaggagatactaaactgtggacagggttgagaacttcttattgggcatacaaatcacttggggatttggttaaagcacaggtgctagagtgaagactgagagctgatacttctaatttactctaggagatgtgcatgctactgatctatagcacatactttgaatagcaaggatttagagtgtctgattttggtttttgcttaagaagactttccttactttggattataaaacgttttttcttctatgttttgttctagtatgttctatcattttaattgaaattataaatactcactttattttctaagaataaattaggaatctaattctattcttttaaatcaaactccaaccaattacaccccattgattaggtacatgtaaaaattttgatataatttcagagtaacataatatatttgtattgttcttttaaacgtcttcagaaaattcacatattgacaaaagtagaatatttttaaaataatataaataaattttaaaatcataaaattcatctttctgtccatttgatctttaaatttcaaatatgtttatgctaacaatgtaaatacgacttaaaattaaaaaccaaattcctgaaaaagaagaatggaggatgtgatcagtatgttagtttccatctttatcaatgtttgtggacactccataggatacagcaacaacctcagtctgtaacagtaatttggtaggaggaatgctattgtttggaagaatatactaccaacataaactagcttctgctaagctcagggtacaaaatctttcttttaacattgtaataaaacgcctacagaactgaggattttcaaatacctgtatgaggatgttgatgatgttgatatctacaaggtaaacaatgggggtgttttatgcaaagataatttaaggtactcaattcatgcaagaatgtaaagaaaaattcaagtgtgcaagagtttaacccaagctgataagtcaggagtataaaaagaaatgaaaactgaaataagaaagtcttataactttcattaaattatctcactatgtaaatactttttctaaagagataaatgattactgaataaatgagctgtaccccagaataaattttactaatttagcctcgctactttccattatgatatcctagtagaaataaattttcgttgaataatctagcccttgggaactcaatagatacgtatctttttctctgtgaagtcacagctcatttaatgaaattggccaccaacgcccagttacatctttcatgcatttttaatgaaatgtaatttcttgagctagagattcaaagaatctcgttttgcatctaaaattatgttcttcaaagttttggtagctaaatcggaaagttctatagcccaagattcttgttattaaaagaacaatgactttgaattgccagtgcaaatatatattttttctgctgaactagaaatatcattctttaaaaagccatgaaaaataaaagtcaatgctgaaggtattttattatatataacctttagttaataagaaaccaatgtttgttttgctaaaacataaagtccaaatttcgtgattgttttgcttgtttgtttaatagcaaacattgaaagacaaaatacatttttaggatcaaaacatgtctacccgctctatatactaggtcatgcacaaattgtttttctaaaggtatcaattatcccttcttaaaaacttacgtgtgagagttaatcttaaaagtcaatgttaaaagcgttttttttttttaattctatattgctttttcctgtagggttactgataactaatatcaacggagaatatcgttatattaggctggtgcaaaagtaattgcagtaaaaaaaaaaaaaaaaaaaaggtaaaaaccgcaattacttttgcaccaacctaataactctcagatgttcttaaattattaagtaccttttctctcaagttgtcttaggtatggttagattaaatacacatcaccaaagtgtatagctatagtgtattttatatacccaagtgtttgtcttcagagcagtcctcagagaaaactgccatcatctgtattgaacatgtgttctctagtccttccatattggttaatgattatatatttgtgtatataccaagctaaatcatatgaaattgccaatatttggttttctggcctatacaattagaagttgaatatgattcaaacccaatatttatgctttgggtgtgaattaccagtttcttccaagacacttgatcctgggcgatgggaatatgtttagcttcttcaaattgacttgaacagcctcacctgaaataaagcctttcttttctggacatttccaggaaaagccagtcttgctatttcttgaatagagtgaactgttgcaagtaaactggatgagaactgttatctgactctgactcattttagtttaatccagctgccagttgttcataaatgtctcttgggacctatgtagattcttcacttattagattaacactatattttcatgaaaagatagtcttttcacttaaaatgaggagttaaattttgccttaaaatctgaactcctgttagtaatatcatgttcatacatttcctaattgtattctgaatcacaaaaatgaataattctgattcatcataacacaaatgcttatattaacaatattttcctgcacatacaatatattattaaatagaatttacttagtatgggagactttgcaacatatctcttatctcctttccatttgccttattatgatattttgttagaaattttggccggccacagggattcatgcctgtaatctcagtgctttgggaggcaagggtggaaggatctcttgaggccaggagtttgagactatcctggacaacataacaagatcccatctctacaaaaaaattagccaggcatggtggcatgcacctgtatgtagcaggaggatctcttgagcccaggtttctacattacagtgactatgattggatccctgcactccagcctgggcaacaagtgaacctgtctcaaaaaaggaaagaaaagaaaacaaaaagtaccagcttgggctcagcatctgattcttgccttggccttgttccaattgccattgccttcaacaagaggatttatcatttcccaattctaactcccaccccaactgtatattctaactgacccatggattctttcaatattggaaactatgtaagattaagtttacctctttgatatatttctcattaaagcattgcatgcatttcctcacattctcatgaactatattggtgaattggtatggtaagggtgcaaattagttttgcctttttcctttataagtggacattggtttctaaaataattctaccaggagctagaattattggcagactcaaatcataaaactttttgttagtttctcaaattaaaatattttgaaggttttatttaaaattttaattgaagtataacatatgtaaaagactggcaaaattgtaaggattcatctcaatgaattgtcatgtggtaacccatactcaagaaaagagacagaatattagtagctaccatgaggccctactttctcctccccactagaaagagttacttttacttctaacaccagagatcagattttctgattttaagatttatgtagttgaaattacactgtgtaagttcttttattgcatcttttcctcaacattgtggttataagagtcatccgtatcactgggtgcagctgtaatgcctccgttctcattgccctcatacaaatccattgtatggacattgcgcaatttgtccattctactactaatgaaaatctgagtggttcccaggtcttggctcttataaataatgccactatgatcaccatataatttcttttggtgcttatttctggaattactaaaatttaggatatagctatatcaatttagtaggtaacagttaccaacaagttgttaaaaataggtgtcgcaatttacattcacactagcaatgtttgataattgcacctgctccaggtcctcacctcaccttaccagtcttacttaatttagttatctttgcaggtgtacaatagcacatagcttttaatgttgattttgttttattgattatcaataagtgtgaacaactttttaattggccatagcaggaattcatcaatttttaaaaatctatcaacttaatgcctttaaataatgaaatattgtagactcaccaacattgtttcagaagttctaatagtctacctgtagaagtataagaaagtacaatataaaatcttgtatctatacatctggaatattgctatttgagaacactaagaatttctaggtaactctagcatgtgccatgaattactctaagaactttacagaaactaagtggtttaattttcatgagactcacatgagtctaatacaattgttatctcaattctacaaatgaagtaactgaggtacagaaacagggacataacttgcccctgctcacacattaaataagtgacatacaaagtgtccccatgctgtgaggcctctccaagttttatttaaaacattagaaagtagagtagaataatacatattgatgtattttttagaataataattacaaatagagtaagtttgaaataatattgaagatttaccctatatttaacattccctaaatgcaaaaaaaattctgtgttgctgaagcaaaatacaacccaagctgatgatgaatttcataaaagactgagataaacaaatatattttaaaagaatttttaactctaagattgggtaactctttctacattagtgtaatgagaatagtgaacctttgaaatgagtaaaaaatatggaaaatgttaatgatcttgagttgcacatattttgcattatgagcaacatttctggttgctaaatgctaactatattatgcacagtgtacgacgtgggtgagttaatgttgctagggaacttttagtgtctagattgctttgtttttgtgtatttaaatttgcaaactcaacattatgttaggataccttctggcatttaattaggttccattccatgattttaaacttaaatgtgccttaatgtggaagattttgttatttccatcttccattccatttcttgttcctagtagttataatcataatatagtgaaatagggtacttagcgtttcctagtagacctgagtacaaaatatctttagaacatctttaaacatttttgtgaatgtacctttttccttctaggtaggagatcttcctgtttatgggtccatgataatcactctccaggagaggggagttttggatgccatgaaatatccatactaaaaaaaatgaagtccttaaattaacaagagaagggtctctccccatgtgacaggcatacactttagccccctaactagggttgcccaatttagcaaataaataaacaaacaagacatccagttaaatatcaattttgagtaacatttttaagtataatatgttccaaatattgcatgaaacatacttacataaaaaattatgagttggttttcttaaattcaaatgtaactggccattcagtattttatctggtaactctgtaccctgaaagagataatgagaagatcacatgaagtcaactattgctacaattctcctaaaatgttttctgcattatagaaacagcaagaaataaacatcaccatttaggatcagcaatgcctgctagacccacaccaaaaaaaaaaaaaagaagaacaaagaaaaaaaattactgattactagacataaggatggtttaaagggagaatttgagcaataaagagatgataaacccttgaacttgggaacacacagaactatgtaagctctatggaacaccctggcatgcttccaaaatactaggccattggactagactattaggaagtagaatgtcaaatgtctttttctattatagagatttagttaaacccatgaatatttatccagcatgcatttcccaaactgttctccacagaacatgaatgttcagtaagatattaatagatgctccttgaaaaagtatttgaaagtcaaaaacttatgtaaccctttcgttgcattttccctgctgtagcataatcaatgggagcctatcttaggagttgtaaggaaaaattgcatgagttcaagttctggtcaagcaatgtgagacatcaggcaagtcatttaaccatcacgtacctctgtttcttcatctgtcaagtgaaagtacttatagtagtttcctcatacattaaaacattaagccttttagaagaaaacataggagaccttggggctggcaaatgtatctcttagatatgacacagaaaaactaaccaggagagaaaaaaattgatcagttgggcttcctcaagattaaaaatgcctgttcatcagaagttaccattaataaaatgaaatgcaaggcacggactgggagaaaatatttgcaatacttatatccagctgaaaaatttatcctgaatatataaagaattatttcaactcactaataagagggcaaaatacctgaataatgtacaaaagacttgaacagaaacttcataaggaagatatacaaatggtcaataaacatatgaaaaattactcaataccattagtcgtcatgaaatgggaaattaaaaccattatgaaatactactacataaattctagaatggctgacatttaaaaagactttccaataccaattcttgacaatgatatgaaacatctggcaatttcatacattgctgattggagcataaaatgttatagccacattagaaaaagaaatctaggtgttttttttaagatgttaagcatatatctacctatgacccagaaaattaatttctagatatatatcaagaaaaataaaaacatattcacatcaaaaatttgtacaggaatagttatagaagcttaaataataaaacccccaaactggaaacaacccaaatgtccatcaacagaaaaacaggtaagtaaatcacagtatgttcatataatgcaatactactaaacaatataaaataatggaatgatgatatatccagaaacactgatgatacttgtagatattatgatatgcaaaaatgcatttatgtgaaggtccagaacaggcaagaactaaattatgaaggaaaacagaatcattgttgccatttgtgtgggcaagtgtgaaaaatgacaagagaacagcatgaacaaacttcaaacctaccagataaagaaaatatcctatattttgaaaaaggtgtaagttaaatgaggggttatgaactgaattgtgttcctgtaaaattcatatattgaagctctaaaccccactgtgactatatttggagacagggcctttaaaatagtaattatggttaaaggaggtcacaaaagtgagctcttagtccaataagactggtgtccttacaagaagaggaagagacagcagggatgtgtgtgcacagaaaaaagatgatgtgaggatacagagagaaggtggccatctgtaagccagcgagagagacctcagcagaaaccaacactgtgggcaacttgatcttggacttttagcctccagaactgtgaggtaatacatttatgttgtttaagccaccgagtctgtgctatttttgtataaccaccctagcaaactaacatagggagtatatgcttgtcaaaacttatcaagctccatatacaagattggttgtttcagtctatgtaagttatatttcaacattaaaaaaatagaaaagagtggtcattatctcatatgtcggttgccgaaaatataagttgatcaaaactatttcacatctttgggttccctaaaataaagtttaagtttggggaaaaccctgggatggaaatgcttccaaatcccaccctctggtgccatttgtttattcagtgctttttgtcatggagtaaaatcaaacaaattgtttgagattttagaattaaaagatttacataaaatttcctgagatataagtggtaaggatgatgataatgataatggattttttttttttttttttttttttttgagacagagtctcgctctgtcacccaggctggagtgcagtcgcgatctcggctcactgcaacctccacctcccaggttcatgccgttctcctgcctcagcctcccgagtagctgagaccacaggcacccgccaccacgcccagctaattttttgtatttttagtagagacggggtttcaccatgttagccaggatggtcttgatctcctgatctcgtgatccacccacctcggcctcccaaagtgctgggattagatgatggatttaaagcagtttgagaacatgtgataattaagtcatagaattttatggatgcctcttactcccaggtagtagagagtgctacatttccaaatggatgaagagccagataatttttttgccatatcaagaccaggcatttttcagacattatcatgctgaaatgtaactcttctctgaatacatcataatccggattaaaatttctaccatctgtaatcttaccattaggccacatagtttatttgtgatcatgaatactgttcctttgaatcttcactttgcagtgtagtatttttcatatagtaaactctgagttttctaagaagtctgagatctttattcttattgagtctggttcctagtcattgagatatcagcattaggataaaaaatagtggctaaaagtaattattccaagtgactgaaaaattctgcctaaatataatgtgttgaattttaataaacatattatcatggcaatggcaataatttatttcttttctctacccacccctaaaatggccccatgatctatagttgataccaattcatttcttagaaatatgttatgctttacataagaaataaattttgctattcaaacatgataaaatataagacaattaattccaggatcatccaaaatcaacaaatctatgtgttccaattcgtaattaatgttcaacttgcatcctgatatgagcaaaattttgtgtttattaaaataagagagtgaagatgaagtcattaaaagttcagattcaattcagtagatctgttagagattcttaagagatagttcttgcataccctgaaactcttagtttaaaagaagcagaagtgaggtggccaagcgtgatggttcacggctgtagctccagcactttaggaggtttaggcaagatcactggaggccagcagttcaaaaccagcctggtcaccatagggagacctcatctctgcaaaataaaaattaagcaaaaaaaaaagaaaaaaaaaattagcagggcgtgatggtgcacacctatagtcccacctacttgggaaggtaaggcaggaggatcacttgagcccaggagtttaatgagccatgagccaccactgcattccaacttgggtgacgaagtgagactgtctcaaaaaaaaaagcagaaatttttactggcaacatttgcagaaggttgtgggttggatagcataaccagagcacatcagtattaaactcacatgtagccactctatgcatgtagaattcattcacagaatattcttatacttgacattcctgggtaattgaagtctgagattttttgttgttgttgttattttttgttctgtttcatttttctccattaaaaatatgattgtacccatgatagaatcaagtgatagtaaaatgactaataacagtaaaggagttttgttaaatctttatggaaacaaagctgataaaatatttcacatataaataattgaaatgaactgagcacttacatggtcctgcatatgctcctcatcccttctgagccctaacttcttttaatcttttgtgacatagatactattattaacataatttcacagataagaaaatttaagcacataagttaaaaaatattgcccggccgggcgcggtggctcacgcctgtaatcccagcactttgggaggccaaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagagagactccgtctcaaaaaaaaaaaaaaaaaaaaaaaaaatattgcccaagttcacacagctgatgagtggaagaagccagatctgaacctcggcaacctgcttcctaagtctgcgctcctaatccttaccccctgttctttaactgggttaatttttatctgttagagcatacatgtttaagaaggtagaaacaccagtgattaatttactcaaccaacatttcttaggcaatacctgtcacgttttaagtattatttgttttaattatttagtaattatattattaaaaaaccattccaataataccaccccaagtcttctagctaatttgggccacctctccagacagcctggctgtgacactcagtcagaaaaagttttctacgaaagaaatgctatactgtttcctccgtcaatatgttaatgtgctggttctcaaacacttgctgcattttcaggtcacctgggaagcctcttaaaatctcaatgtccaggcttcacaatacaccaattaaaccacaatctcttgaggtgagacccaggcatcactatttttttatagctcctccagagattcattgtacagcaaactttgagaactagtgtgtgaatatatatttttttaattagcaaactgtctgaaattgtctcaagtgcccaattaccaacatgaatagtaataagaagtataggtgttaaatctctagcattgagttcaggcaaactgtgattcagatctggattttgctactttatcgctatgcaacttttggaaaatcaccatttatgaacctaaatttttttattcatagggtgggtatgatgatcacctctctgaatctttgtaagaattaaaaagaagacaaatgtgaagccaaaatattctcctcccagttgaccacctctcctctggtgttctaacaacagcctctccagccagttgggagtatcaacactcattagaaagtggttgcttctgctggcaatctctgcactcacccccaatttggcctccagctcaaagggaagacaagctttccttcttaattcacaatagcatcacacagaagaagccattaccattcagcaagaatgtattgaagcttccaaaatgaagagtgacttacatctgttattagatgttattaggttcagagctcacgggccccattctggccctgggcttcctcaccaggccgcctttctgtataactcccccttagtctccatgcacaagggccagcttaacttgtaccactagaatggattgttcaatgcagagatgtggtgttgtccctcaaaaaatcagaacacatctgtcaaggctgctgaatgtcctatgagaagctgtgctaaattcactcaaacccttatcccggcctcttctctgacataaggtatcgatcttgcctacaagtcattcctgctgctcctgcaaacaatgctcagtgatttgtaatcacggatcattcactgcctctgtctcagtgtgatcttcatttctcttcagctacaaaaacattttgatatacttcaaaatttagagtaaatcacagagtttgctaccaccaccactgtctagatagaatagaaatggaaaggaacaggataaaaatagagaactggggaaagtgtacacatggttgatcttagccttgtttctctaactgttcatgaggctatagttagtatttatctcttccttcttccactgtccattttgtgctcccattgcacacagtgttcctatagctgactggggttaatatcgttgtgggttgacccatacctttatttctaaagaatctgagctttccgtgatcctacctgaattaggttgctcaagtgttttaataaaaagtgtaattagagtatacattccactctgctttctctcttcttccattcagtttaatagtttaattgctagacctgtcaatactaggagacaccccaaaggaccttctgatttccacgcacactcttctttgttcctttgtgtagcagaaaccttctctcccccatgataaccaggattaaacaccctaggaaacaataatccctgttattgcctacaggagccacgatatgaggagcccaaaatgaccaactgtcaatcccgccttcacttcaatgaaaccactgtggtatccctcatgcaagcattaagagacttgaattttcaaatcgaaatgaatttatgcttctcacattttgaaaaatgtcatagctaaaatatccctcaggatattctggttatctataaaatctttaagatttccttttactataattgtgttagttactatactcaaagatgagcatgtgcaatgcatttgatacaccagaaagctagcactgaggttttgaaatacatattttaaacagacagtagttttaatctcaaggcagctttgtatagtaagtcaaggatcactgtaacagtcagacctacattcttcatgctttcaaagaaaatataacttattcaacttatgatttagagttctaggtctgtccattgacaggtgaggttaatggaataatattgcagatatttttggaagaccatttctccaaatatggtttttttaattcaccttatttcttaaacatttaatgctttaacacttgagaggaacttatagttctcaaatgataagagagatgataaaaagcagacccacttgatttcagatttccttaacatttacaaatatgttagtcttgtaattacaatcctgtttttaatattatagtctcatgttattgtctaatgatatttaaattcccttgtgcttaactctgtctcatttagttttattttctattattagatcacattgtgcattaccctctcgtgtcttaaagaactcattacacttttattctttaagaaaattccgtagctctatttcaattatgttgcattctattggtaatctatacaagtaattaatgctaaaataaataatctcatattcataaaaaagtgtcatatttctgagtagttgatttgccctatgcatagtccaatcatgttgagaagaaaaaaggttgagatataaatagcttataaagcacattttcccagctcatctataaagtgtttctagtgggaaaaagattccttatgtgtgactagttgaaaaggaacaaatgtaaatgattacactcaaaataaatgtattttctactgttctgtgcctccaattttttctgaaaaagatattaaggcacattataaggatatttaaaataagcataagtttataaattaaaagctgaatggaagaagagagaaagcagagtggaatgtatactgtaattaccacctttgcccttgctacaggtaaatcctaagtttgacaatgctgtaatggcaaacataaagagaaaccagctcaattatatagttcttggtttaaaggggaaagataaaaacaaactaattgcataggagaacaagtattctttgtactaaatcagaaaggtgatctctagtgggtcctcttgaggagaatccagagagacagagtcaaggaattgagaacatcctcagctttctccgagtagatgaaacaacgagtttcaaggcactcttttattctcatcttcatgtaggcagaggaaagtaaatcaaaggcaattgcattaactaatgttaaatgggtgtcttagtccattcaaactgctataaaaatataccttagattggataattcatgaacaaaatttatttatcttggctgggaagttcaagatcaaggccccagcagattcagtgtctggagagggcccaccctgctccacagatggtgccttgttgctgtgctctcacatggaagaaggggcaaggcaattcctttcaacctcttttataaggccactaatcccatttatgaaggcaaagatctcaaaacttaatcatttcccaaaaggccccacctcttaatactgtcacattgggtattaggttttaacgtactaattttaaggggaaaccaatattcattcttttgtctttttttggatagtttgttgaaagtctttagcatgaaagtgttgttgaaatttgtcaaatgcttttctgtattattgagatgatcatgtgatttttatccttcattctgttaatgtgatgtatcacattactcgatttgtatatgttgaagcaaactcatgtctcattgataaatcccacttggtcgtggtctatgattctcttcatgtgcagtagaatttggtttgatttgctagtattttgttgaggatatttgcatctatgttcatcagaaatattggcatttaggtttcttttcttgtattgtttttgtctggcttcagtatcatggtaatgctggtttcataattgagtttagaagtgcttcctcttcttcagattttttcagtagagtatgagaaagattgccattaattcttcttttaatgtttggtagaattcaccagtgagccatctgatcctgagcttttctttcttgggaggtttatggttattgatgcaatgtccttcttcattattggcttgcttatactctctatttcttcatgattcagtgttggtagattgtatggttctaggaatttatccatgtcatctagagagcaagagtgatgatacttatataagacaaaatagtctttaagcccaaaactgccacaagagacaaagaaggacattatatattaataattatatgaggtttcatttcatcagtaagatataaaaattataaatatatagtcactcaccatcagaacacctaactatataaaataaatactgataaaactgaatggaaaaatcaacagcaataaactgatggtaagagacttaattctctacttacaataatgaatggaacattctgacagaaaatcaacaaagagagagcagccttaaacaacactgtagatttagtacacctaacatacagatacaaaatataccaccaacagtatcagaatacacattcttctcaaaggcacacagaacattatccaagatagatattctcttagttcacaaaataagtcttaacacatttaagattgaaattacaccaagcatcttttcagaccacattggaatgaaactagaaacccacaataggtgaaactccagaaaattgacaaataagtggaaattaaacaacacactcatgaacaaccaatggatcagaaaagaaatcaaaatggaaatttaaaaaataccttgatgtaaataaaaatgaaaacacaacataccaaaacttgtagaatacagcaaaagcaatactgagggaagtttatagcaataaatgcctgcatttaaaaaaatctcaaataaacaacataactttaagtatcaaggaccaagaaaaagaaaaaaactacatccaaagttagtagatagatgggaagaaaaaatattaaagcaggaataaataaaatagagaatagaaaaacaacagaaaaaaataaatggaactaaaaaaattttttaagataacaaaatcagcaaacctttagctagactaggaaaaaaaaagattcaaataaaatcgtaaatgacattggaggtactgcaactgacgccacagaaacaaaaggaatcataagagaccattatgcacaattacacaccaatttcttattaaatatctacttttggtgatctttctttgcttctgactaacaagaaaaagattcattttcaataactagttttttgaaaaaggcttcaacagcacaacttttgacactgtgaagctcctttaaaaaaaaaaaaaagaattctgttgtaatacagaactttttcatacaccttccattcacttgggggtgaggagagttgaggacatagctgtcatcaaagatgtcagatgcagccccctagataagcctgaaaagttcatcttcactcattagtattttttttttctcagaagctcaaatatctttctatatagtctggcttactttggagaactcattttcattgtgagaggcatgcaaatatctgaattccaattgtggactggattcaagtccctcacagagttgatgggccccatgaaataatatcactaaacctatgtcctgcttgtgccctgataggtaagccctgagatagtctatgatggaatactggttgatccagaatatgtaaaatcctctaagaaagaaaaaaaaatcatacataatttcacaaaacagcttgcttatctcagacgagaaccagcaaacatatctttttctaatatgtatcaaaaacaacttttctggtcataaatacttcttgttggccgggtgtggtagctcacgcctgtaatcccagcactttaaaagtctaaggcaggaggatcacttgaggccaggagttggagaacagcctggctaacatggtgaaaccctgtctttattaaaaatacaaaaattaactgggcatggtagcaggtgcctgtaatcccagctacttgagaagctgaggcacaagaattgcttgaagctggtaggtagaggttgcagtaagccaagatagtgccacttcactctaacctgggtgagatagttggagactgtgtctcaaaaaaaaaattgtcaagacattatattttctatgggttgtttattggtgtctccactatgagtgccagaacctgaattgaaattgttagttgggagtcatatgggccagatatcttattacaaaattatttaaacatttccttagttgatatagataactaaaaatacgaattcaggaattcttaattcacacccagaagactcatattcaagtccttgatggttaattacagaataattaatatattgtataaaaatcctattttctgtgcattttttgctcaaaaatggatgtatcttttcttgttaattctgtacaaaccaaaaattttgaaacgagtctcctcagtggcaatttgaagagggaggcaaggatgctaatgtttcttctctagtgatttatctaaatcatggacaaataaactcacatggaatgctttctggaatagaacttggcggctgatttgtctgcatcaagcccaggttttctcctcttctctcccaggctgttatcctagcagcacaaaggcctgaccttggagggcaagtcagcctaattcccggagtcagtgaacgaagccattatctctcactctaaggtctcttttaaactagtttttaaaagtaacaaagatgggccgggcgcggtggctcacgcttgtaatcccagcactttgggaggccgaggcgggcggatcacgaggtcaggagattgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagcttgcagtgagccgagattgcgccactgcactccagcctgggccacagagcgagactccatctcaaaaaaaaaaaaaaaaaaaaaagtaacaaagatgaacatctacgtcaagcttgtccaacccatgacctgtgggccacatgcagtccagaacggctttgcatgcagcctgacacaacttcgtaaactttcttaaaacattatgagatcttcttgtgatttttttttttagctcattatctactgttagtgttagtgtattttatgtgtggcccaagagaattcttcttccagtgtggcccagggaagccaaaaaattggacgctcttcatctacatcatcctacttttcagttggcacagaactcagttgaagaaagacatgctattcattgggccctggcatagttctctgggaccagtataaccgaaaaccctagactggatggcttataaataacagaaatttgtttctcatagttctggagcctgggaaatctaagaccaaggtgccagcagatttggttactggtgagggcccacctcctggttcatagacagctgtcttcttgcagtgtcttcacatgatggaaagggcaagggagctctcgcaggtctctttaatctggtcactaagcccattcatgagatttccaccctcatgacctaatcaccactgaaaggccccatctccaaatactgtcatattacgttattttggggggacacaaacatttgtctgtagcaggcctcctcaaagcccaagtttaaaaatgtattaattgcaatgcgtgaaaatgatgaggaaaaagattggacaagcaatgatgcttcagcaaacctgtggcatttaccgctctgtcttcctctcctactccaaggagtttactcggcatcaacagcagccttattctaggcctcaattactttttatccttatcccaaccccaacccctgaaataagggaacatcaaaggaaaagctagaagtcataaagggaaaaaaaagatgcagctcagtgtgagcatgttagatatggggtgcttttgagacatccaagagtgtagattcagcagcaaagctatcaaggaaagattaggattggagacctaaacgtgaagaatgtgatgaccctcagcacactgggagccgaggatatgcgagggattatgagctaggttgaggaagaatccatccacagatttaaacagaaaggggccgtggaaggaggacgtagtacgacagatgccaagatgtgaataatatagtaccaggaggaaggaggggctggtggtattttatttctctaataagtccagtcttcactagatgtgataatttggagttcattgatgatctttgtcagatgtattttagctaagtgtttgggaaagatgcccttttgcagaaggtggaagaatacatgggagctgaggcagttaaatcttggacaagctccatgttcaaggaatgggatgagaaggtacggagagagaagacatcatccagacgagcccgggcagcccagtgtggaggggtttttgagagtcctgagtatgtgcatctgctgaaggtagggaaatagagaggtggaggatgggagaaggctggtggtttgcaggaaaaggataaccagtggggctagttccagagaaaattaaaagtgatttgattccctaatacaagtggatgctgttacagtttggattgtgttcctcaaaatgcatatgttgaagtcctagcccctctacttcagactggtgctgtatttggaggtagggtctttaatgagaacacattcatctgtaagctaaggagagagttcttcagaagaaaccagacatcccaacactttgatctcagaattctagcttccagaattgtgagaaaataagttttcattgtttaagccagtggaccccaacctttatggcaccagggaggggccagttttgtggaagaaaactttttcacagaccagtggtgggggtggtgcggggatggtttcaggataattcaaatgcattacatttattgtgcactttatttctattattattatattgtaatatataacgaaataattatacaactcaccctaatgcagaatcagtgggagccctgaggttgttttccttcaactagatggtcccatctgggggtgatgggagacagtgacagatcatcaagcattagatgctcataagaagagcgcaatctagatccctctcttgagcagttcacagtagggtttgtgctcgtatgagcatctaatgccccactgatttgacaggaggtggagctcagaaaggtaatgcaagcaatgggaagcagctgtaaatacagatgaagcttcactcatttgccaactgcttaccccccagtgcgtggcctggttcctaaaaggccacagactggtataggggttggggaccctagtttaagccacccagtctatggtactttgttatggcagccctagcgaactaacacagatcaataatagaacaagaataggaaaaccttattgttcggaagcaggagaaaaagaagcaagccaggctattttattagaacattattcgtgtattaatgtttttatctttttgtgtgaccagacatgctaggtgaagtgacaaatgaaccctgcacagatctttgaatagaaacatctcataggaagacagcaatatatacccaaacctacaaaatatagaacagctatctctttgaataatccaggagtctaactcaaaagttttcaaagggaaatatgttgtgacttaagactgtctagatgttctgaagacaagtttttttaaaaaataccccttaattgaaggcagagacactatcgaacgtatcagaggaataagccagaatgagcagtatcttcttagtatttaaatcccttggccttaaaaggcttccactgagtgcaagaaattcaacataattggggagaaaggtgaaaccatcattattgttgaattgaagacaaaaaaagcacatcccttctttatccttgacaaattatgaagccctactttaagcaatttaggataatatggcaaaattatgtggcagttctctatggtttctaataacatgttttcatggcctatttctccgaagccatgccccaggcattgtagttagcctcagacaccgttttctcactcaaatggttgcaactcctggttttctcattgtgtctctgcctgacataagttgccctgcaggcaaccttcctgatcctccttgaatgtgcttttcccccgtattgtcaaattttctatgtacagtaatcctgttctacaaaatattggccatatctttcaattggcaggcacccatatctccccagactgaaatgatgattgtgacaattattgactattacctcctagcaagtcatcagatcacctaatgctgttctctgcacactcatctcactgctacagtctgtgctctctgtacaatctatgatgcggactgcagtcacagttctgtccacagcatagcctccctgaaatctattccccatactgccttccaagtgtcatttctggaagataatgatgataataactagcatactacacagaagaatctgagctgagaacctcacatggattattatgtttaatcaactctgaaacgtaatgagaaaagagctattactaatcctatttttaaaaataaggaattaggattcagagtcattacataacttactcagagacacacaacaagtaggttaatatatcagacactcaagtctgacctcacacctgcaggctgaacctctgctatacactctcccacttacccctgaaaattgtcatcagttttttacataaataattctgataaaacctttcacatgtgactctaaaagtcttctcagtctcttcatttatgttgcctctgtgtaatctaagttccaaccgtctcaaaccaatttctgtgttccaaatgacctattactttctgtgcctctgtttacttgtacatgttgttatttcatttttccgaatgttccatctgaaaaacatatatgtgttattttagatgctaccatactttactaataggaatgatttaattatattatcaacaaccttgataaagtcaaggttatgttgtacctgttgctttttccctgattatcaagtcctggatttctcaaatttaatcttatttaaatggatttcatgctaaccctggttaaaaagcatgaaaacatgctccaaaacataagtccctttgaccttagtaaatatctagaattattgaagtgggtacatgttttcttcttaccccataatatcactaaatagaacagagtgcaattactattataattactgtaagtgtttacccggctacatgatttgtcaaatttgattcccctttaaaaatggcatcttttacatccaattcaccaagcatcaataaaatataaaaacaattataaattgaatttccatgcaaatgtggccttttccctactctgcatgaatgcacaccatcaaactattatgcttcattgttgacaatgtactggtgaaataaccatgaaatagccatgttctaattgttttgctagttgccaaggtcaagattcatttttccccaagaaattttataaaggtcattacagcttaatgaaagtttgcatcccctattcatcaaaaaactgtagactaattctcataaacattcaattaggcgtttaaaaaatagaatcatatttctatcaactacagacagaaatttctctgaatttctcactcccaaggatttgaagcaatggtggcttttcagagaattgttccagtaatctattataataaaaaaaataagtggtatggtaatgtaaaagaaacattagctaatcttcctattatacttagtcttgatctattcttctccagggtattggcctgaaaagggtttctcagataaagaggtgcatgaagcccttacagagagctcagggcagatactctgaagtggttaacccacagttttcaagcatgaccagggctatatctatacatataatattttcaagaatgtaaaatcttttattcagatgttttactatgattcagcactgtcaaacaaactcaatttcaggacttttgccagtaacacgttttgagggtaaacaaatatgattggtttagatgctattaacattccaattaacatttctcaacttgtttaagtgaccagagtaatacattgccccttgttcactgaaatgtaggtttctcatacttctccactattaacaccacttcttatagtcactgtgcagaattttacaaccctaaccgcaactggctcttgggaaaaacaaaaaaaaaggaaactttccttcttcaagtattgtaattgtttcctgtttcgatttgacttagatttcctgttctggtgatctcagattgtaactattgcttaagaataggtttgtaaccatctgataacctgtgaagtgattgcagaagaaaaacacaaaagcaactaatgcatcagtcttgtagtgtttaaattaattttaaatgtattttgtaaatgtagtcctagcttcaaagtctgaaaaatggattagtagggaatctgtgattggaaattgtcacaggagaggttttgcagtagtatgattatttgactgtaaatctctctcccttaccccacataaataaattgtttattattaaatatttaaaataattattttatttataaaataaaaattttatttttaaaaccaaagccagagtcagagattagataactggcactttctatttattagaaaatttaccacagacaaaaaaagatcctctaataagcaaacagaatatatgaaaataagattggggagaattatgagtatgaaggagaaaaacagctaacaaacaaccagcaacaactaataacaataaatgttaaggccttttaacacaagaaaaaaattgcttcaagtacataatttagatataaattatctaaccacaacaatgaaacacagatataaattatagctgaataccagggataatagggtctaaatatatataattcctttgaattttatctaaaatatataaactatgatatttctggttttactactttgcatttacattttccaacaaataagatatatttttagagaggtgctcacacatgcaagcgtgcatgcatgcatgtgtatacacacgcacacatacacacacacacacacacacacacacgattagaaagtctcctgtgctctccaattagcggtacccataagaggacaggatatttggaaaaaggctccatcacgactgtgtgtacccaaaggtcacttacagcaaatgcagactcaaatgcagggaggaaaaagttatcaggggattcctagccttgccgatacaactctgccttcatgacatgcgtattacatgcattgtgtatacaattcttaactccagaaacagctttgaagttgtaactaaattcagcataatctctactccttttattttccagtctttatttttagggaattttccttactgcaaacattgttatgataatacctagtttttattgttccatcatatgttaagaatttcataatcatgatgaaagtccattgctaactaggaaacatgataagtgcacacatttcatgtagataattcacatacaccagcaacaatcctttatggttattcaatacagccctatttatatagaagggaacccaggtcagaaaagtttgagaaaactgtccttggtcatttgtctagcaagagatagagatattatttaaaaacagatctgatttcaaattctcgctgcctctgctgctgtgagaaggtcttaacctctatgaaatctggatctgtttaaaagtcatatataaaagcttcagcttattattctactttctaatattttgtctgtagcactgacactgttttcaaattttgacttgttatttaaatttgatagttttctgaaatggatttccagctgtgtgtttctctattacagttttttaagtgttagtgtgtcttgccagcttacctcttaaagaggatttggtgtagaaattgcttctgaaatcagtgactcagcacttcagatttttgttgatttacagttttgggatttgctatatgtgtgatgttggttaattatttaattggttttagttataaaatggtgttttaaggcaatgcagtgttgttgactggagctttcacaaaagttactggcatttgtggtctgtactttcagcccttaattctattttattgatcatttcatcagggaaggggttttcttttcttttcatccatctctgcttttctaagtacttcttttatttaaagctgcctctaattatttctaaaaatggtaggtccctaaatttttaactatgttaaaggtggtatcagttggattatctggacactgcccattctaatggccatgaggcacgctcattacagaatgaagtgctctgagcaagatgggaccaggaaccgggggagactgtgctgggtattcatctacacagggacaatccgcttctggttaccttacagtcctctgcacattttatatgtgctatgatatccttcatcataaaaaatccttaaatataaatgacaaaagaatgactcaaaaggcttctgtaatgtacccagccatacatttcataaatgatggaaagagcttgggtctaagggttgtttgaacatggatggtaatgaatagtacagtggaaagaacttgcagtcaggaaagcccatgtggaatcctgtcttttgccatttgttaagctccatgattacaaatcaattacctaacttctgagttgtagccttcttatctgtaaaaggtgattaattatcctgctttgcagaactgttgaggggattgaaataatatagtatatacataaagcactgtgtagagcacctgatacatttgtggtgtatcaggaacttagtaaattagttccactataactactatcactaagaaaaagcctaataaggaaactattgtctcaatagattctgaggacaagttcagggtgaccaacaacacaacaaccataataaaatgtttctatgtagagactgacagtggttggttgtcaatacgggttgtgcaggtcagaaattctctgccatggggatacttatgtgagtgaggcttaggatttgagagcgtaccttgagcaacccagggaatattctgtgtcacaatctgtcagacactggagttcatcctgccaaacggtctccacctctagtcagtggctggaaagaaggacagaaccagagagcccatgaccatagggagccttccttccctggtctccactagagcccattcatactgctgggcagtcgggataaatgcattctcctgggtgaccttaaataattgtttaatgaatattttaatatccctgcccaagcaaatatagcactactgacacagtaaaaataatgttgagtgggtgactttcaccatgagaaagttttttcaaaaggtttctgagaatacattaatgagtcagaaagcctagtgacaaagattcaaaatccaaattatatgaaattacttatcagtttgttcccttcgaatttttatccctctgtgtccagagtaccaacctgttttatacaaatttatttatatttccagaaaattggtcgacataacatcactgtataatatatgaatgctttctctaaactaagaacgccccacaggtcccttgcctttgaatagttcagtattgtaatagctaatgccttcctctcattttccactgtataccacctcagagcactgtgtttgggtctgttaacttggttctcttgtggcagtttctcccggtggctgtttacacaggcccccaaggatcctgcattagatggcacctgttgctttctgtgtgactcaagcagaggtaagcactgctgctttctctgctggtctcaattcacaagaccccatgagaagcacaggcactcagcaactttgttgtcattcatgatttcacccagatggccagcgatatatgacagtcagaaaatgtcacagtcaagatcaatatatacaaactgctccccacaactccccaaaatagtgataatcaccatcatcacaatatggatacgtgagctgagcctatcacaggcaatacactgttttctttgagtctggggaaatgagaaagtagactggggataatgatgacaatcaccaggccttgtgattttatggagctttatacttccaaagtaccctcacatgtaatatcccttggaacacatctttccagaagagactcatattgaaactgagataggcagtactcatgtaaaaaatttcctgcccttattcaatatcatatgtggtaaaaattgttatctgatgccatagaatggcttatttttatctttcattaaaaaaaatttctcacaaaagccaaggatgactttaaatatttccatgttgttgcaaaattatcagctctttcaataattgagtcttttcaccacactgtatttcaaatctgccacactgatttagacatgcagtctttctatgaaataatgtgagagcacacgttcttcagcttaggctttttgtcttcaaagtcagcttatgacatggttaaatgctgatatgtttatttactttgatctttgttaattactggtaattgatatgattagcaaagacacaaaactgaaaaaaatatgtttccaaagaagaggaatgtctccagaaattgtcttaaattcatcccctcagcacttttgcaatagcagtggcctcttgggtgttgtttatatgagaaatatttccacgtgatttattaatttattatgaacaagagctgatttattgaacaatttgatagttcattttcctctgacactccgtggtttcacaaaatccctcaagaatcaaatttttagctagatgtgttaaatctcattgtaaaccagtcttcttacattctcacttagccagtatatatatttcaggagaccgtgtgtttttatctctatggatgtggttattagattagtgacaaagaaattcaaatctgcataagcgtattttcttagcaaaagcaaatgacgtgagtgaggttttgcaacatggtgagtaaagttacctcctggaagaagagagaatggttcacagacccacattaatattcatcagggaggctgctgctgagttgatttacatccaactttagataatcagctgacttgagtggtgacaatctgattttgtgaaaactaacaactggcatcttcccagagacattgattaggaaatataagttttcttcagttcagaatattttaacatcatcaaattacgtactatgcagcgaagacagaattctatgtttgtccactgttgtcaaaaatttttgctgatatttcccatttacaggaaactaacacatttcaagtgcttactttgcactaggtaattttacatgatatagctttggtatataatcaaaattttttcaacgcaacaagtatttttgccctgcatttctagtgatgtgaccaactgacatttcagaaaaatttatgttggtatagaatacctaaaatactggaaaactatatataagtctttatctgtgtatcatggcagatagtaaagtaagccttccacatagtaagactcattctggaggcagagcttgtctcaagggcatttaccaattttggtggtctcggctagactctagaagactagagagcaatgttcctcgaaggaataacaacactccttagctattaaacaagcaaaaatgactccacatgatttcaaacgattccaaacatggaaatagtacccttaactgggaataattgacttagaacctggtttgtaaatagtcctagaaaggccagaagcaattttctaaagctagaaatagcaaggttcaaagtttgagagatttctatacaatttcaggactttcaactggcaacaactttagagtttaaatgaggaaggaaggaaggagggaaggaaggagggaaggaaggagggaaggaaggagggaaggaaggaaagaaagaagggagggagggagggaagctactagtcacataaaagcatattttaaaatctttacttcagctgtgggaggagtagagaaaatgaacagtctcctctgagaatttctaactcaaattcgtagacatatatgacctgaaaaatcctgtcaaaaatttaagattaaaatggcctcaagatgataggacacccaaaaacctagcagaattacttggaataattatatattaaatgaatgctatttaaacagatgcctcaaataaatctgacaaatatttctaagaaagttaatctcacagtataaaattactcaacctgctcagaaaacaagccaacatgaggaaaatcaatgaaaacagcaaagtacaaatcagccccacaaagactataagcattagaatgatcagattcagcacatgaagcaaatatataatatgtttgaagaaatatacttgggaattgaaagccctataaagtaatagtaaattatcaagattgactaaatatatgtcaaaaagaagcaaaacaacttgtatttaaaaaatcaacaaattgaaaattaaaaacccaagtaaaaagtaaatatcagattggacataactcaatacaaccaaagaagttccccagaatgcaagccagagagtaaaacacagaaaaatttatattcttttcttttctgttgctgatgtcaagtgtgcatctggtttttagttctgtaagtgtgcacaccatcttctctatcgttaggaattttcatggaagaggacataatctcatgtttccccttctttgtagccccccagaataattcagcacctactagccttttgattttaagacttttatgacttatcactggggagaaacagaaaaaaatacattatttaactgtaggatttttgttttgttttgttttaatttttttgtttgtttgtttgtttttgagacggagtttcgctctttttgcccagactggagtgcaatggcactatctcggctcaccgcaacctccatctccagggttcaagcctcccgagtagctgggattaaggcatgtgccaccacacccggctaatttttgtatttttagtaaagatggagtttctccctgttggtcaggctggtctcaagctcctgacctcaggtgatccacccacctcagcctcccaaagtgctgggattacaggcgtgagccactgtgcccggctggctgttttctaaaatttatatacaacatcgtttctaaagaaggacttgataaaattagcaaagacacaaaacataacaagataacagaaatggacattggattctcatcataaagccagggtaaagtaaagataaacatatatgccataaagcaaatgtagtacaactatgcaaaatcatctttttcattctcacattggccttcccatccagagtgtgcatgcatactaagtccattctgccttgatggagtcattttggcaccttcctgtgaacctgaatccttggtagtagcttcacttatagactctcctcttcacctgtatgaagttatctgacctgtgttttctctgaagcccagtcttcgagttcatcatggcagcctgcccttgttactccccatgtagacagcccccaggactccacaaaaggcctttctcaatccatcagctcttctcttctacatttacccaatccccctattctattctttccctctgtcccaatatgcttctcttttcagatttgtatatctccttcctggacccaaccacatgtcacccaagtctttcctgttctttttatagaccctccagtgattttccatcctcagcgtggtatcacacctttctccacgcattacctctctgtcctctgagcctcatccttcctgcctgctctctgattggcttgagagatgatctaggaaaattgttcccaacaggtagacataagctttggaatcccacctctcctgtagcctgaagaaataaaggaactgttgcttgccctctgaaggaggtaaaagtctttgatcttcagaccaggtcaggatagatctggaactgggaagacttgcctttttttcttggcttctttgtgacttccctccctgtgatcatatcagcgttttgttcttggatgtctgtactcacatagcactgctgagctacatccataggttgagggagtctgatggtttggtaacatttttcttagaactggctgtcagctagagcatgagctcttgatttagaaaatttgacccagaagtgcacaaaaaggcctgtgtgtggcccttgatgggccttgtgatgacaacacaaggtaagcatcaggggcttgaccgtgggggagcagataccacagtggttaaggacatggaccctgaagcctgaatactggctttcgaatcgtagctatgctcacttaataactatgtggccttgggcaggttatttaaactttctgagccttagtttctccatctgtaaaatggagttaacaataatagtatggctatcccttggtatcttggtatccgaggattggttctaggatccccacagataccataatctgtgaatttcaagtccctcacaggccacccttggtatccatgggttccacatggatggattcaaccaacgatgtcaaatttactgatggggaacctgaagatattaaagctgactgtaattactccatgacccttttataaagattaaaagagttaatatgtataatgcactaaaaacattgcctgcttcatggtaagcattatgtaaagatttactactagtttgtgttgttgttacagatggtgaagataaaaaggcatcactaaattttgcaaaacactctcagagaattccagtactcattgggaaatcacacacacacagacacacacacacacacacacacacacacacactcaacgttctccattcaaattcctttgtttttactttctgactctataattaaggttatgtttatgattgaataccctttcacttttattctgaacatgcattaaaaagtctgcatccttcaaatatctatgtttgatagattatgtctatccctttctctaagaaatcttgtcatcccagtaattagaccttcacttgaaattgagaaagtacagggactacatcaatgccatagagaagttatttattttttaacatcttcttcactgggaaaaacatatcactgggcctgtaatctgtaaaattaattctcctataaggacttcctaacaaaacctccctgcccccaattcacacatacacacacacacaaacacactcacacacattcacacttcctgtaaagaaaacatgtgagaaaatactcactaggtttcagggtacaagaagtacccaagttaaagtggaaccaaaattaaagaaccccaatgtatcttataatatttctacctcttataataaacatgctgattcttagtaatactgtatatttccctttgttaacagaggtatttattttttaataaacattgagcagtttttgtgtaccaggctttgtgctagaaacagatgattcaaaaattaagaaagtatctgacataattttcaggtctctatgaggcagctaatattattccattttaaattttaatatctaaagttacagagctagcaaatttggaagcgtaaatttgaaatcataactctttccaaagtttgtgttttaaccactgctaactcctgtactgaacagtgtaagttctaaaaatatcggatgcggctgggcgaggtggctcacgcctataatcccagcactttgggaggtcgaggcgggtggatcacgatgtcaggagttcgagaccagcctgaccaacatggtgaaaccccatctctactaaaaatacaaaaattatccgggggtggcacacgcctgtaatcccagctactcaggaggctgaggcaggagaaacacttgaacccaggaggtggaggttgcagccgagatcacaccaccgcactccagcctgggccgacagagcgagactctgtctcaaaaaaaaaaaaaaaaaaaaaaaaaaatcagatgctgggcagtagaacgcaatgtaaactgtataggattcaaaatcttctggttcaaaattcattcactcaaccattcatgtattaatttaaagaacattttttgaagatctaatttgtgtaaggcactatggtataagacaaaacaaggcaacaatgatataaaatatagacaaagccaatgaagaacagggacaaataagtaattgcaaaaaaaaaaatggagagtgcaataaaatgtgaaggctctatggaagcacaaccaagacatttcagcttgtttaggggattagaaaagacttcccaaaggaagcagaatgatgtttgagggctagccaagtaaagaggtggaaaagtgtattcctaaggaagtggtaaggtctgagcaaaattacatgtgagagaaagaaggtttaagaaacaaatttatttgaccaaagcatagagatttatttaaaaacaaaacaaaaaatagagatatagctagagagctggcaggggtcagatctcagagagctaataaagtcaggtgacattgattggaatgggcaatgagagacactaaggactcaaggacaagagaatagagactacatttgaagagaaggggatagatagatttaagaaataccaagaaattaaacgttgtgattaaatggacatgcttcttattaggaagacttccaagtttcaggttttaaatagtaggtggttgtggagctatttttattaaaataaggaacatcatagtgaaactgatttgggaggaggaagaatgaattcagttttgaactaattaagattgaggacatccaagtacagtctgtagctggatatatgtggtggtagtgagagggtatatttcggctgtgaatagaggtttgggaattcttctcattgagatttgaatcacgtcataaaagtgaacaacattgtccaggtagagtatgtggagtgaaatgaaagggctgtagagtgaactctgaggaacaccaacatgtaatggttagataagaagaaagatgctactaaatgcctgagcagtactgaattaaaaaggaggcagttatgcaagagaatgtgatgacataaaatgcactgtttctagtactgccaagaagtcagcaagataagtacttaaaagcatctgctgaattgaccaatacggaaatatttcatgaactagaaaaaaaaaacagtctaatgaagtctggtggagaggggatgtgttaaatcttggggtttttaaaaataaatgtattatctgttttatatcctttgggaacttaaagtcttcattgtctctcctactagacttttttttttaaattttactttaagtttcaggatacacgtgcagaacatgcaggtttgttacataggtatacatgtgccatggtggtttgctgcacctatcaacctgtcatctaggttttatgccccgcatgcattaggcatttgtcctaacactctccatccccttgccctccacctcctgacacgccccagtgtgtgatgttcccctccctgtgtccatgtgttctcattgttcaaccccctcttatgagtgagaacatgtggtgtttggttttctgttcctgtattagtttgctgagaatgatggtttccagcttcattcatgtccctgcagaggacataatcccactcttttttatggctgggtagtattccatggtgtatacgtgccacattttctttatccagtctatcattgatgggcatttgagttggttccaagtctttgctattgtaaatagtgctgcaataagcatacatgtgcatgtgtctttatactagaatgattgataatcctttgggtaaaaggtctaatatccagaatctacaaggaacttaaacaaatttacaagaaaaaaacaaagaaccccatcaaaaaatgggcaaaagatatgaacagacacttttccaaagaagacatttatgtgaccaacaaacatatgaaaaaaaagctcatcattacagagcattagagaaatccaaatcaaaacgacaatgagacaccatctcactccagtcagaatggtgattatgaaaaagtcaggaaaaatagatgctggtgaggctatggagaaacactaacacttttacactgttggtaggagtctaaattagttcgaccattgtgaaagacagtgccgtgattccttaaggatctagaaccagaaatactatttgacccagcaatttccaactagactttaaactccttgagaaaatgtgtcttcttattctttatatcccttgccacatattaaaggaattaataaataagtgctaattttcttacctataaaggaaagagaataccttctccttttatatgtcacaggatatttttcaggatcacagtttacatgaaacagttgtaagctgtaaaacctacagaagggatgattgttgctattaattctggattgcaacaattcaagactaaaatagaaaaggtgtccaagacagtttatgatttattgccaatgaaatacttaccaacagtagttgctctgggaattcagaaaaaaaaaaaaaaaaggacatttcaagatgaaagcattacggcatttctcagaattgctaagaaaatatcccgggcggtggggagtgagacatgaacaaaatgtaggctgtggaggactatatctggatgcagggaatggtgaataaaccagtgagattagcacaagaccatcttcaaactttctaattcattctaaattcttggcttagacaagaagaatgcattattaagttttaatgattgttttgaaagagcatttatagtatttgctgttctgcagaatgttttatgatttatgattctaataacagacagtacttgaacgtgaaagctaatttgtcctcctattgtgtaagtaggcttccactttggggagtagagcaagtgttggcctaaaaacgtctcctgattccttgtgccaaacttgaccttctaatttggaaaacagacttcacagcaacttgtgtaaaaattaatgaagtcttttaacagtgtaaggtacagcaaagaaatgtattgattttgatacgctacaaggttattgcttacaagcataaaattattgtaatatccagaagtttagaggttaaggaaatgaatgtgaagaatgcctatgtgtgtgcacatgtgaaaatattggggttctaagaaaattgtgtagaaaaaatgtacgatcccctgttcacctgttctggttagaaagaacactaacagatatgaaggaaaccatagacttctagaccttgtgctgatatgtacagaaaatacatagaaaatgaagtctaaaagacccttgctttggcatgtctacaaagaatagcaaaatggacttgattgctattactgaaagccacattattccccacccattagataatctccctatctccagtttcattttgtcctatccttgctttgcagtgttgctggagggatctttgttcaacatgaacccgatcatgtcaccccttgtcgtatcacatattgtgatggcttgtcttccctttagaataaaatcagaactccttggatttgtaagcagggctttccacagtgtgtctcccaccaacctttccaatgtaatctctcatcaccattcaatatgcaccgtacactcaaacataaaagcattgtttgcatttcctcagtagcctatgattcccctctataccttccacgcctgcttttctgcagctcacagattcttatacatccttccaggatcggctctagcaatgcctcctcccagaagctttttgtgaaccatcaccaccctcaccactagactagtgtgtgtgtctgggtgatgcaagtgcatgtgcagaagtgtgtgtgtctgtgtgtgtgtgcatgtacacacatattcacacatgagctgtgctttactcccaaacaccccaagcccaaggctggccatggcatttatctttgaaaattataattatccaattttctattttcctgcagatcataaactacttgaggctttttcatttcattttgcccatagtaggccctcgaaaaatattcactgactacttaagtgagtaacagaccaactaaggaactgaagatatggttgatattagtagactagcaaattaagcaacgtagcataatgagaatgcttatgggaaaaagaagaaggttttaaagcttcccagcacactatagatccaaatgtaaaacatttgtccacttccccctgaaaaaggaagtttatgtgtattgtagtttttaccatgggtcttaaattatagcacacttttacaattattttatttttaaaaacaaaatatcatgtggcagaagacacattaaaaaagatctcccagacaaggcgtagtggctcatgcctgcaatcccagcactttgagaggccgaagcgagcagatcacttgaggccaggatttcgagaccagcttggccaacatgatgaaaccctgtctcagcaaaaaatacaaaacttagctgagcgtggtggcgtgtacctgttgccccagctacttgggagtctaaggtgcaggaatcacctgagcccggggaccctgtctcaaaaaaaaaaaaaagaaaaaaaaatcctcccaatcgtggatagtgatagatgcctaaaagtggctatttaatactcactcaaaactaagaacatcttggttttggacatctttgtaaatgatcttctcagaggtcactttagaaagcaacatggtaagtggttctaaccacagataaatgctacagaatacagtttaaaagactgaagtccaaatatatgggcatacagtttccagttatgcaatcacatatcgatatgacgtgagcatgctgtatctcaagcaactgaaacagatccgcagctctggaaaaccactggatcactctagaaatagctctaaccataatgaaggcaatggtgcagaaggtttatgtggagaaaaatggcttaaaaatgttcattgggatttagatggggaaaataattatttctaagcaaataaaatattttatgtgctcaaattaattaactacattagtcgattaaatattatatctagacatttggctattgtatctaatttgtaaaagttaaacattttatatggccaattttaagaaaaatatgtatggaacatcagttccataatgggaaaataggagaaacaccttgtgtttgctttgtatttagggatataatgtataataataaagccctactaacctgagaagaaaatgacacatttcttaatcatcaagactagacaagccagcactatttgagtgattaatcccagaaattaagtataacttagaaaaacatgttttcacttacatgtatatatgaattttaccaacacttaaaaactgaaaaacttggagcttctagtttaaaatttctttttgaacttgagaatcttttattgatttatagtcatttcctaggtaaagaagtattggatctcagtttgattcctattacctcttggataccttaccacacctgtaagaagaaggcaagcattaagactaacatgatgaggctctgagaagttaagtaactgagctagccaccaattgatctaatgtcatagtccgtgcttttacctcccgaaaggaacaatggtggatctcactggaaatgtaactgtttattcttgagtctaaattctgcagccttaaaaattaaacacatgccacttttgattcttattgtgtgcaacacagaatattttcctacatctcccagctatttttctaaatatttttcagtcactttaaatgaatggcatagtacaacattatgtgtcctgttctgttttattaactctgaatgactgtgtgttagtgcatgcagtctctctctctctctgtctctctctctgtagttgtactgtcttttttggaaaatttactacttctgagaatgagcataatggaccaattttttactctttgtaactctagatgaaatgtctacagttaatagagcaatcaaatctgccctgctagggaaaatagcattagaggaaggggactcagaggcccatggtacttgtctttactattacttgttaatgcatctttgtacaaaacagatattttattcaaaacctgcctcaactcctgctgcttattctccttcacctcaagtcactctcctctgttttccaaaatatcagttgctttatggggaaaatattataatccagttgtccatgtgttgctttgtaataaggagatagagcattaatattgactgactttcaatctaaaccttttggacaaacttttgttggaatgcaacagggagcaacattagtaggcggggtgttgatggacatgcaaactgggggaacctcaggaaagtgaatcccacttttatttgttctgtcttattacaatttacttgtctgtgatatattcattaggcaattgaaaaaaaaatgccatctcagatatacccaaaccacacctttggaaatcaactgcagttaccacttcatagtttgggatcagtatccagccttccagcagttccttttgtaatctttgtccataaataaacctccccctcaatttaacaaagacaaagctttagatgaactcgcttcagaatgaacatagtataattcacttttcaatttcacacccaaggattctgtaatgggggaatgtaggcggttaagttttcagtcataccaaatgggtttttaatacttaaaatccatctgtttacatacaaagagtaaatgcctggaaatgtggcttctgaaatgcaaatgaagagctacaagacttatttctgcttgggaaaattcaacacttttctgacaaaagggagtaataatagctcctgtaaaatccaataatattataaatgatattagatccaatagtgcatgatatgtgtatggggaaatctatggtctcttgtttgttattactgcgtcgtgaaatgcttcataaatttgaggaaaggaaggatattcaaattagcaaagtactttgcaaatagtcagctataccaattttaggatgccttggcttataggaacaactaacagatttaggaaactaaacaggattttaaaaaagatagtttccattgtaactcatggagcaccaaggtgtaggtaaaattttgctgtaatagctttttgccacaatttagcctcattctgtttttgtttttgttttaactttgagaaattaaagtttacttttaggcaattaattcttctcagttcatgacttcataaaggatcacttacaatgacagaccattctataaattattattaatgtacagagattaaaaattgttaggcctgtaaataaaatgttaagatggatatttcatacaatccgccttcattaaaattactagcattgaaactcaaccagatatgttcccattagtaagtttcttttgaaacgcataattagtatttcacagattttaatttaaagtattgttctacctatttaatagagcaagaccataaaaacctaaccatctttgtttaaataattctcttttagtttctgaaaaatgaatgtgttatttatggtaatattattttactgctatttttaaaattccaaaatggataatggttaaacttttaaaagtttatttctcattcatgaaagtcctaaacaggctttcctgattggtagaaaactcactttcccctggcaaatgtttggcttatgggaactgatgccgcttctgtcttgtgactccatcatcttcatcatctctcatttcgtaaaatctttgccacagaaattaaacaaagcgagttcagtcttattttgccaacaaaataagaaaagtcgtcaaaattgagaagtagttatatgggttcatgtaggtattggtgcaaaatggctggaaaatgtagttttgaccttggctatcaattcctagaaaaaccctacactgcacaaggaggagcaaaactctttggaggccaattagcatagaccactaagagtactgattctccaagtatggtctccatctgcattaaaagcagctgatgagcttgcctactgtcttactccattttgtgttgctttaaagaaatatctaaggctgggtaatttgttttaaaaagaggtttatttagctcacagttctgcggtctgaacaagaagcatggtgccagcatctgctcagcttctagtgaggacttttgtgtggcatcaaaacatggcagagaaggtcaaaggggaagtgggcaaaggaaaagagggaaaacctgaggctttataacaactcgctttcaagggaactaatgtattcccacaagaactaatccagtctcctgagagggagaagccttttactacctgagaaatagcaccaagaaattcttgaggagtttgccaccatgacccaaacatctcccactctcccactaggtcctacctcccaccatccccacactggggatcaaatttcaacatgagatttggtggggataaacaggccatatcaaaaccacaacacctactttcatattctggagccccacatctgatccactaaacctgaatgttagagggaagctccaaggattctgaattttaacaaactcctttgttatttttagcactaaagtttgagagccattttagaagaaataacacattagaatactcaaatctatatctgtctgtctgtctgtctatctatctatctatctatctatctatctatctatctatctatcgagagagactatgagaggatcctgggatcttctcatgccagttttcacctcttccttagctgatacaaaacttcccaaggagctttgtttgctattgagtttgacattttgatatttctttatgattaatgcaaaatgagtatgtatggctaatttcctatgcatttcctcccatataataaatgaatgacaaatggctccagaagcacaattcatttttatggctagcttttttttatcctaggatttgaaatatgagcaccttgagtctaattcaattctaattaaaataatactcattaagtgcttcccccgggttgtgtgacaaatggtactaaattggaaaaaagacaacccaccacccacaggctgtttatattctaaaaaacagagtaatataaaatgcttctccttttcctttcctctgatctttataatggcctgctggatatctccattatctcaacttggatcatttatagacttctcaaacataacttacaatagaactttatgcttttatttctccataatcttgtttgttaccttgtattattttccaaatttgtcagctccatcatgaacacagcctgttctctcatattaaatgctgaatttccctgtactgaggaatatacacatttgttagctcttaggtcaatagtttctttaactggatatattctttgtgctcaccagctgactaatggcatagaatatacaatggacatgttaggatcatcggtaatgctgcctaaattccacctatgacaaatatggagagagaaaattatttcttcaccgaccactctattggtggccaaaattaactatcagtattacatagtatatgtaatgataatgtactgtgagactcttagtggatattaacctatgttatcaatcaaaaggcagaaacactgattactcattaagcatgacttgttttttttttttcaccacacttggaatagatgcttttttgttgtggtggtgggtttttgtttgttttttgtttgttttgttttttgagacggagtttcgctcttgttgcccaggctggagtgtaatagtgtgatctcaactcactgcaacctccgcctcccaggttccagtgattctccttcctcagtctcccaagtagctaggattataggcatgtgccaccacacccagctaattttgtatttttagtagagatagggtatctttaaaggagctgaaaaaattactattccagcttaagcaagtatcccctccattatgccaccaaacagtatattatggaacatctgattttcctccatgagataactttaagtgtttaatgttagaaataagacattttggctgggcgcggtggctcatgcctgtaatctcagcactttgggaggccgaggcgggtggatcacgaggtcaggagttcaagatcagcctggccaagatggtgaaaccccatctctactaaaaatacaaaaaattagccaggcctagtggtgggcgcctgaaatcccagctactcgggaggctgaggcagagaactgcttgaacccaggaggtggaggttgcagtgagccaagatcatgccactgcactccagcctgggtgacagagcgaaactctgtctcaaaaaaagtaaaaagaaatgagacatttcaacttctattaatacccatttctatatctttctccacatttatttgaactcttatgtgataaatgtatccattaaatctgtatcacttttatagtaatatttccataaagtatggaaaattcagctttataattcctttcctttggctcaaaactacagttttttcaatgcaaatgttaaatcatagttatatcttgttttttaaaaaacacatttactctcgacataagttccagaatattatacatttcaattttatgcctttttcacagtcctattttatttagtatatcctcttacatattaaagaataattttaatttgaaaaaggatctcaacacatacttatttttaaaagcatgtttttatattatgttttaatgttgtccaatttagtactgtccgatttttaaaaattgtatttatagtacaaatctaaacatgcctatataattatgcctcttgggaaatatccttattggatgtctcagtctgttctagctgctataacaaagtaccataggctgaatggcttataaacaacagaactgtagttctcacatttttagaggttaagaataagaggtcagggtggccccgtggttgagttctgatgagggccctcttccaggttgcagactaccatcttcttatatccttacatgagaagaagaggagtagagaactttttgggtctcttttataagtgcactaatcccattcatgagagtttcacctccatgatctaattatctcctaaaagctctacctcctaatatcatcacattggaggttaggatttcaacatatgaatttgtgggggagcacaaacatttagttcattgcaactggagtatttgtgggtttgagtaaaaaaaatattacaaggagagtgcttttaaaacatcatagaatagtgttagaaatacctattttaataccttttaagtgagaattttaagagacctgagtcattacgaactaggcttatcttcttcttctaactccaatctctggatatcctgatatcacaataatgctttatactcaggcacatgaatagaagctattgaacccatctagtgttaagagagatcacaataaaaatattttacttaaacactttccacccatatattcctctaatccagagcaatagagggaaacattctaacattgttaatgagagaaatcttacgtattgttatatttaaagtatatcttagggttaatagaataaatgaggggaaggtaacaaagtgaaattcacaaatgccttcggtgatgagtaatttcaatggcaaactattttttttccaatttcatcagagtatcaccttattctaatcagcattattatcttggatataaaagaattaatagataacatgcttctgaaaattacaaataatttatccctggaccagttaacactgaatgacaaacttgggatccaaaaaagccctgacaaattggaacaattgtccaaatcaaatgggagaacacttaagagggacaaatatatctaagtatccaactttgtaagtacagttgcagatcaaataattttaggacctatacttgaaaaataagcatataaacttatataaaacatatacatatataaaaacatataaatatataaacatataagtgttatgcagtttttgaaagaattactattacattttaaatacgacttttctttttactaatttattccttaacattttcttgaatcctggatgatgctatttaagagttatgtaaatataatagaatgtgttaaagagtgtgactggccaggtgtggtggcttatgcctgtaatcccagcactttgggaggttgagacagatgaatcacttgagctcaggagtttgagaccagcctaggcaacatggtgaaaccccatctctacataaaatacaaaaagttagctaggcgtggtggcctgtagtccctgctacttgggaggtgggagaattgcttgagcccgggaggcagaggttgccgtgtgctgtgatcataccaccacgctcctgcctgggcaacagagggagacattgtctctcaaaaaaaaaaaaagaaaaaaaaaaaagtgtgaccaagatcaagaaggggtttcacccaaaagaatgatttatttttctatcctaggagttgtttacacctgaattcaaatgtttattcagagcctgcatgaataatcattgaagactctcaggttctgtgatcctgtgtagttaacagaaaacaacactctctttacaaacactctgtttctctttaattatactaaatttcactctataaaacacttcaattttaaaattgcaatagtttaatctaaggacagtattatttcactttcttgtttgtacaatattgtatatacacatatatacatgtatattttatagacttacacactatcagttttgggaaaagcaaatgaatatatataggatatcattattcaaacttactatgtagaattttttattcacttgagtaattctagacaaggagacatttacatatttatcactgaatcaaggattttaaaatcaggcatattaacactgaaatggttcttttgtaaaaggaaaatacagtaatttgagggaaatgtataaatagcaaaattacattcttttaaccttgcatgaaaactccaaaaattaattggttacataaatcctattatttaacaatataagtgagaatattagctatccaaatattgccagatgtaattaatgtccttaaatattgccccattagcatgcattcttatgagctggagtcacaaaactaatggatttgctacccaggggacatcaattggatatgacactgcctcagttctctgcacgccctattctactgtctttattataacatgattacttttcatttgattctataaattgcattctatcaaattactatagtggagcctgtgatatgatactctcactaattaaaatctttgttttctctacacttgggttaatatagatagttatttttcttgtttcttactaaccactggagaaatacgttaggaaatacttcaggctcagcatcttttgtgtcattaaataatagttatttttgctttgccatatgtagaaaagagtctacattattttgctgtggggagaggtatgtaacaattacagtaaatgctagagtttgagttttctaagaagtgaaattctagtcaggtaggatttgataatctaaatagaccagtgactgacattccatatccttagagacttcataatgagaaaatctctacattcagccaagtttaatttgttgtcaatacattctagcatttagagaggactttgaagactcccagcatatattcagaaaatactggcaacatcaataggattatttgagtgtggggacattaaatcacacaaaaagtatatgcttattcactattgttctaagagtccttcctccacaaaatttgaaaaagccccaggcagacagagtcctagtttgaatgcttctgccttttcatttctttttttttttttaaggtaagatatttggctcagatttcaattgtgaatattagagagaattctgctgcttcagatcttctctatccatggcattttcttccactgtcaaataactggatctgtcacgacatcaccacctttggtatttaggaacctaaggcaaattccctggtcttattgcatgacaaaatgatctctggctgcacaatatataatttgatcaacaacaacttaaaaagcttctttattatacataggccatctgccttttctgtgtgcagtatctgaaaacacagcaaaatcctaaaatacatgatccaaacatattggcagtgattttttttcttggaaaatcaaataagagaacctgtcatttttctttagaagtttgaggcgagtgacctctgcatacctctcataattatttcttgcttcttaaatgccaagtggctcattcataacagcaaaatataatgaggaccttcgagataactgccattagaaacatgtcatgaaatgtatcagtacatgccaggctcttgattacaaccataaatatccagaagaccagttgcagagcccagtgccagtttgacatttccagttgtaagactaatagaaaggagcaattaacaaataaaccctctccctcccacccctcattcatgcctttgctctacaaacatttctaaatttacgtctacagttccatgatggattttaaaagttttaaatcatgcaattttggtacctatcatccaaacacataaacaaattctttttgaaacagtcagaaatgttatgatatttcttctccttgaactcacactttgattccattatccttataaaatattttgtgagacttgacatttattctattatttgcagcataaatgttacccagtaattaatgccactcactttatcaactatatcatcaatatttcaaattgttctttatttctttcttgttcagaaagaacaaactggtacagtttgtaccagaagtttcttctcttccaggaaaatgtatcatagtaagattatggaggaaacgagtctttccttcataaagtaggagaaaggtatgggaaggagaaattggaaaggagagcctgtcagctgcagtacattcctaggcagattgactgaagaaagtaagtacatatagagtttgaagttctagaaattattcctttaaaactattcatgtggtttcttaatcctgtgtacatcaaataaatgcgcatgcaggtctagaaagccagtatgctagttgcaatgaatctgtgactctgtatatgttatcagaccaagtatgtcctgctcctctataaaggcttatagattttatgtaattaatacatatttgaaaacctcattttgtcgttatgtataactgttaaaaatgtacaactatgatcatggggggcatttaaaaaggactctcatatgccaaaaataaagaaaaaaacgacttgattggtctaacttgggaaaaatattttaatgtattgctgagttaagaataaaatctgagaccctacttgccagttgttattaacaaacagccactggttctaataatctaaatattaacccaattacatgatgcccttaacgatttaaaggtatggctttatctttttgagaaaggaaaaaatttcttaccattttcattatttctcttaagtaaaatttgctataactctaccacctggcagttatatattgtgccaaggaggatcattaactctgccggtctcagaagtgctggtgtgctacgtctgagccatgacatcactaagatgtaggttggtgcaaaagtcattgcgttttttgacattaaaagtaaggggaaaaccttcaatgacttttgtaccaacgagtcatagaaaatgctacttagtcacattgcttataatggattcccccactctcatccagattgccagctgatgagagtgtataatgtgcctttaaaaaaacaacagcaaaaaagacaatctcttcttcttttactgtaagaaagaagaaattttttatgaaaatactgggtaacacaatgcaaattttgaaaatgaaacgacaaaaaagttaacaggtaaatttctaaatcctgaccttgttccagtgtcatagtagaggttttaaataatttgaccagtgtaggattcggacactctttttttcattataaaatggtgtataatggggaatagcaaatagttgtaatttttaacgttgaattacatcagctctgtagccatcagagaataactagcaccatatttgccttcctgccattggaaaccaaaacctagaaaacttaaaaaaaaatctttaacaaaagatttcaacaactgaaaactaagcagcatagagctgtgactcctgagaaaaagaaaaatggagtaaggcctatcatccttctctctgcctagagacatatttaaaaccacagtgcaggaacagcaagactcaaacacagcagagaagacttgctgaattgaaaagagataaactcgagttccggaagattatggtgactggtatttgagtagtagaatactggagaggaggtaactatacagagaaaaatctccaaaatctacacagggatccctctaaggattttgcccgatactaagctgatgtgcctggagtaaaactacgtaagtctaggcagagagatactactggaggatagtaggctgaataatttccaagagtatagagacatttgagtttcctcagctggagtgaacagacctcattaaaaatttgggcagtcagtaagccctagaagtatcaaatttgagagtaaagaccattctagacctacacaaacaaaacttgaaaaccagcctggaaaggtcaagatgatcctaaagtaacctaaatactggccataacaaaagttgctactctataatagaagataacaaaaatccagaccttgaaaacatgaaatacatcatatctagtgtccaataaaaacataaaagtgtgaagaggcagaaaaatctgaaccataacccaaaaacaaaaacaaaaaaaaatcaataggaacaaaaccagaaatgattggaagatgaaattggcaaagaactttcaggcagctattaaaaatatgctgaaggacttacagaaaatatgaatataatgaggagagaaataaaatgtattttttaaaaactaagtgagaagtatagtgttgaaatattaaatatttgaaataaaaactcactagatgaacctaataccagattagacaatgcagatggaaaggtcaacttaacaacatagcaatagaaactaatctgaagttcagagaaaatgaacataagctcagttactatggtagtttgtttcctttgaaactcatgttgaaatttgatcactaatgtggtagtgttgggaggtagggcctagtggaaggtatttgggtaatggggcagatcactcatccatacattaatgccctcctgctgcagtaagtgcttgctctcacatgactggataaatcactgaaaataggttgttataaaaggcagttcggcttcctagaccctctcttgcttcctctctcacgatggatcactttgtatgtgccaactggcttttctgctttctcacagtggttttgacccagcatatgcccctctccagaagccatccagatgcagctctatgctcttgaacttcccagactgcagaattatgaatttaataaacattttttctttataaactacccagtttcaggtattcttttataacaacacaaaatgaactaatacattagagacctctgaaacaacagcaagcagtctaatacgcttatagagtcccagaaaagggggttaagatctataggaaaaatattcaaagaaatagtggctgaaatttaccaaatttaatgaaaacctgttaaagcaaaaatccaagaagcaaaaagtactacaaatatgataagcacaaagaaaattactcaaaagaacttaatagccaaattaataggaaaaatgtttttaatcactctggggctgggggacacttcttataagtggggcaagaaggatagaagacgtcatcagaaaaaaccaatactgaagacaataaaatgaaacttctaatataaagaaaagagaaaatattcataacttaggattttatatctagtgagaatatattttaaatatgaatgcaaaataaaaatattttcagacaaaagaaacaaagagtgttcatcactagcatttcactgcaagaaattttaatggaaattctttaggatgggtgaaaatgacaccatacagtaatctacatctacagaaagaagtgaagaagatagggaatcgtagctatgtggataaacataacagatgacttttttctcatttttcatctgtaaaacaaaactttaaaacaaaaatattagtacatattatggggtttattgcataatatgtataacagtactataaaggtaaaggagggaaagtgaaaatatactgttataaatgtcttaccttataggtagtgtaaaacattatttaaattaggtttaaattattttaaaccttaaaacaactgtcacaaaacaaagtggaagagtttataagtcaacagaggagataaaatggaatatgaaaatgctcagttaatccaaaagaagatagaaaaaaagaattctcatacattgaccattcgaatattaaatttttcagccacttgggggaaaagattggcagcttctttaaatatatgcttgctttgtgacataccaattaaacttacaggtatttacccaagaaatatgaaaatgtatatacacaaatgcttatacattaatgtttatcacagctttgttcataatagcctcaaactggagacaatccaatggcctatcaagatgtgagaaaaacaaattatattcatacaataggccactagtcagtaataaaaaggaacaaactgctgatacacagaacaatatgggtgaataccaaaaaaagattatgccattgtgctgagcaaaaggagttactcataatgtttcattccatttagataagattctaaatagacagaactaatatggtgtcagaaagcataccagtggttgtcaagtgtcaggaatgttgaaccaggggtcagaggcaggattgttgatggcaaagggcacagggatttttctagaatgatggaaatgtttatcatctttgtttgacagtagttatacaggctttcatttaaaatggggaacaattcatcgtatgcaaattatacttaaatagagttgattttaaaaatgttatgtgtatacataaatacacatatcctaagctttcacttgttaacaagtctaaacaaaattctttagctcttacaagttcaaatatttttgtatggcaagccagctaacagaagcagcatgtcacatgtgaggccataccgtcccacaggcaggccattttaccaaggccattggccaagtgcatttgcccaaaccagtaaatagtcattgttaaaaccaatcattttcttttgaacaacactgcagttgttaagatctctgtaatatcacaaataaataagcaataataaaaacaaatatgaaaatactaaatgggaaatttcacttcaggaacaaaaaaaatcttaatgaaaccatagattaaaaaataaataaataaaacttaatggtatctataggattttgtcttcctgtgcactagaagacaaaacctttaaaactttccttctttttcattttactgtgaatgcatcatttataacatttaactgatttctatatgtcaatgcttgattccatggcaggcaggttaatcttagtggcatgactcattattcatctctttctaattagcacacactatggtgacttagattgcctatgagaacaaaccaggaacatgaataaagttaagaggcagtcttcagatattttgcaccagctagtttttctgtgttccacagcctcagaaagcatcccaaactcactgaaaatcttgtaaatatatgccattctttacaagaataagcagatattgtagacggtcagtataagtgcgttattagtactataaatagaagcaaaactcttgccctgctgagcggtgcattagtaacatcatgctatgtcaagaaagattttcataatatgattttttatcattctttatgctgctatgtgatgaaaagtgtgtaaactggagaagagaagatcgatgggagataggatacatttctgtcaaaattccagagacagagggaaaagagcagactagctgtaagttgcttcaatatatgtacttatgagtatatattacatatctaggtgtctctgttatatgcttgtatatgacaaaatgaatttttttaaaaagatgcagaagtatcaaagaggaatattctggcttagtattaaaaaactaaatactagtgagagctgtccagagagcaaatagacttggttaggctaatggaacaaacttcataatctcaaaagactttaagcaccagtgtgatagacatttgtcaaaatgcataaagaaaaattatgttctgtataaaatggcgatctcaaagtctttgaaacttgaaaatgttttattgaatgataacaactagattttaaatttaaaggtaacaaaattaaaatatgattaaacactagctgcatataccatcacctttgaaaataagaacgattttctaaacagttcttaatatttcctaggtaacattttccttatcttctctacactctagtttaacagtttagtatcttttgtcaaatctttagcatttgtgagtccttggaagcttcagtggccatgtgaatgaatagctgtagttgttaagatatttgaaagttgaaatagcatttccaccatggacttcatacatcagtcttcactagtgatttctgagaagcaaacagattttgctctttctgaagggctcccagtgtgaccacagagcagttgctcttttatccctttgtttccaaataattctcctcaggaaactcactgacattgaaggagcacctcagacacttttgtaactgtgaaagcacagatattagcatttgaaataaaaaatagaagataccacggacgaattggagaaaattggctaaaagcattttatagacaaaatgaattacatcaaagccactgacagtaacctcaatatctgtgggttagtcttcagcagttgcctttcttgtttctatgcctggtgaacttaaacataggtctgtaaagtgtgctgctaaaatataggaaaagtatgaggatttcatccctctacgattttctattcttgtatctccctaaacccacatcaatacccaaaaatctttattaactctctgactggtgctgtgcatggtgataatcattttgggttcataacaaagaagaaaaagtcacaatcttgatgaggaatcagattaatgggggagatagacatggggagataagtgggcatatacatattttcaacagaatgaaatggtgccataataaaagataacaacaaaatgatataggaaatctgaacagtttggggagaaataatttaaacatattaagaacttctaggaggtctctagatatgaaagagaatccaggacattccaggcagaggaaacaacatgtacaaagccacagggcatgaacagggagacagggttcaggaaaaagtatgcggtttggtatggctagaatataagatataaatgatgcagattttttcaccccatagttcagataaaatctgggttcttatctcacaaccagaaaacattaggcatgtggacacattgaagagtgaggaggctggatttaatacgtgaagcaaatgaggatggatttattaagtgaaaaaaaaagctctcagcacagaaagaggggatcctgcaaataggataccatctcacagatcgaataccaggccaccatacaggagctgaagaggccaggctcctccccttgcataaggtgtgaattcctggtggctccaccccattctcccagtgtgtatgtgggcccccagtccattgtgggcagtcctagccaagaccctgtgcaggttcccttatctgccttctgcgtctatcataaagggaaatgagaattcaggcaatgagactgagaaagaccagattgtgaagagccttgtgagccataatatatgtttgaacatataatagcactataaaggatgagaaattaatacaattttaaggtaaaaatgataattttagcaattttagaggtcgggagttccagaccggcctgaccaacatggagaaaccccgtctctactaaaaatacaaaattagatgggcatggtggcgcatgcctgtaatcccagctactcaggaggctgaggcaggagaatcgcttgaacccaggaggcagaggttgtggtgagccaaaatcgcgccattgcattccagcgtgggcaacaggagcgaaactctgtctcaaaacaaaaaaaaaacaaagaaaacaaaaaaaaatagctaataagagtacagaaggtaaaatgagtgagcagaacatggatataagaaggaagtgtatatatatatatatacatatacatagtatatgtatatatatacacatatatacatatatacatatatagtatatatatactatatatatactatatatatagtatatatatactatatatatatactatatatatagtatatatatatagtgtgtatatatatagtatatatatatactactattgcagtagtgaagaatggtgaatgatggcaaggatctgaactaattggcaatcttgctgatgggagaggagtatcgagcttcagaagatattgtaattgaattgatcagtcttagaagttggaagaggaatttaccttggtcagcagcatgattacgatgctattaattcctttaggaaatgtcagtggaggggcagatttaaatagagtgccattttgtctacattgagatgaagaaactgtggttactctgctgcaggtgtctagtagtcagtgggaatgtatgggtctgtaactaaagaggaacgtcatgagtagatatttggacttgagaaatattgatgtataaatgatatttgaagtcttggaagtatttctggtcaccccccaaaaaaaataagagaaaaaagtaaacaatttgtcaaaatataaacaacccatttatggacctatactttaatccctctactctcatgagggtttggtgtacagattattttatcacccaggtaataagcacagtatctgatagatagtttttccaatcctcaccttcctccaacctccaccctcaagtagaccctggtgtctatttttccgttctttgtgttcatgtgtactcaatgtttagctcccacatataagtgaaaacatacggtatttggttttctattcctgtgttagttcacttaggatgatggcccccagctgcatccaggttgctgcaaggacatgatttcattctttttatggctgtgtagtattcctatgggcatctaggttgattccatgccttcaccattgtgaatggtggtgcattgaacatacatgtgcatgtgtctttatggtagaatgatttctattcctttgggtgtatagccaataatggggttgttgacctgaatggtggtcctaagttctttcagaaatttccaaactactttccacagtggctgaactaatttacattcccaccagcagtgtgtaaatgttccctttcctttatagcctcatcagcatctgttatttttttactttttaaaaatagccattctaactggtgtgagatggtatctcactgtggttttgatttgcatttctccaatgattagtgatgttgagcatttttttcatatgcttgttggccacatgtatgtcttcttttgaaaagtgagtgtctatgtctttccccactttataatggtgtcatttgttctttgcatgtgaatttggtgtataaatgatatttattaattttttcaaaaaatcaacttgtaagttccttctggatcctagatattagatctttgtttaataaatagtttgcaaataatttctcccattctgttctatttactcttttgatgtttcttttgctgtgcagaaactctctagtttaattaggtcccatttctcgattttcatttgtgttgcaattgcttttggcatcttcatcatgaactcttttccaaggcttatgtccagaatggtattttctaggttttcttcttggactttttatgattttaggttttacatttaggtcactatgcaccttgagttatttttttatatggtaaaagaaaagggtcaaatttcaatcttgggcctatggctagccagttatccccgtatcatttattgaatagagaattcttttcccattgattgtttttgtcaactttgtcaaagatcaggtggttgtaggtgagttgctttgttcttgggttctctattctgttccattggtctatatgtctgtttttgtaccattgccatgctgttttagttactgtagctttatagtatagtttaaagttaggtaatgtgatgcctctagtttatttctttttgattaagattgctttggctatttgggatttttctcttttttttggttttatatgaattttggaatagtttttttctaattctgtgaaaaatgtcattgtttgtttgataggaatagcactgaattggtagattgctttgggccttgaggccattttaataatactgatttagcatggaatatttttccatttgtttgtgttgtctctgatttctttcagcagtgttttgtaattcttgctgtagaaatctttcaactccctgcttagatgtattcctacatattttattttttgtagctagtatagatgagattgcattcttaatttggctctcagcttggatgttgttggtgtatagaaatgctactaatttttgtatgttaattttgtatcctgaaactctgctgaagtttcagatcaggaagtttatcagatcaaggagcttttgtgcagagactctggagtttcctaggtatgaaattaaatcatctgcaaacaaatagtttgacttgctgtcttcctattttgttgcctttttatttctttctcttgcctgattgctcgggctagaatttctagtactattattcatgttgaataggagtagtgagagtgggcatccttgtcttgttccagttctcatagggaatatttctagattttgcccattcattatgatgttaactgtaggtttgtcatagatggctcttattattctgaagcaaatttcttcaatgcctactttgttgagaattttagacatgtagtatgttgaattttatcaaaagccttttctgcatctattgagataatcatgtggttttggttttagttttgtttatgagatgaatcacatttattgatttgcatatgtagaaccgaacttgcatcccagggataaaacctacttgatcatggcgcagaagccttttgatgtgctgccagattcagtttgccagtgttttattgaggatttttgcctggatgttcatcaaggatattggcctgaagttttctctctctctctctctctctctctgtgtgtgtgtgtgtgtgtgtgtgtgtgtgtgtgtgtgtgtctgccaggttttggtatcaggatatgatgctggcctcatggaataagttaaggaggtgttcctcctcttcaaattttttggaataatttcagtaggaattataccagctcttctttgtacacctggtagaatttgtctatgaatccgtctggtcctggattttttttttggttgtagaatatttattattgattcaattttgcagcttgttattggtctgttcagggattcaatttttttcctggctcaatcttgggagggtgaatgtgtccaggaatttatcaatttattctagattttatggtttgtgtgcatagaggtattcataatattctcttatggttagttgtatttctttgaggtcagtggtaatgtccccttcgtcatttctaattgtgtttatttggatcttttctctttccttcttcattagtctatctagcagtctattctattaattttttcaaaaaaccaacttctgagttcattgattttttgtgtggtttttcatgtcttaatctccagttcagctctgattttgattatttcttgtcttctgctagctttggagttggtctgctgttgtttatctaggtcctctaggaacacctagagtgtgatgttaggttgttaaattgggatctttctacctttttgatatgggcacttagtgctataaacttttctcttaacactgcttacctgtgacctagagattctggtatgttgtatcttagttttaattagtttcaaataatttctgccttaattgcattatttacccaaaagtcattaggagcaggttacttaatttccatacaattgtataattttgagtgaccttcttggtatttgtttctatttttattgttctgtggcttgagagtgtgcttggtatgattttgattttattgaactgttgggaattgctttatggctgagcatatggtcaattttagattatgtatatgcaggtgattagactgtatattctgttgttgttgagtgaagtgttctttagatgtctgtcaggtccatttggtcaagtgttgagtttatgtcctgaatatctttgttaatattctgcattgatgatctgtctaatactgtcaatgaggtggtgaagtctcccactattattgtgtgggagtctaaggctttttataggtctctaagaacttgttttatgaatctggatgttcctgtgttgtgtgcatatatatgtaggatagttgggtattcttgttgaattaaaccctttacaattatgtaatggccttgtctttttggatcattgttcatttaaagtctgttttgtctgaaattagaatagcaatccctgcttctttctgtttttcatttgcttggtagatttttctccatccctttactttgagcctatggatgtcattccatgagctaggactattgaaaacagcatatcattgcatctcgtttttttatccatattgccactctgtgcctattaagtggggcatttagcatgtttacattcaagattaatattgatatgtgcagatttgatcttgtcattatgatgttagctggttataatgcagacttgattgcataggtgctttatagtatcagtggtctatgtacttaagtgtgttttgtggtggcaagtaatggtctttcatttccacagttagcattaccttaaggacctctcataagaaagtaatgaatactcttactatttgcttatctggaaagggatagtttttctcctttgcttaggaagcttagtttggctggatatgaaattcttggtttcagtttcttctctttaagaatgctgaatataggctctcaatctcttctggcttgtagggttctgccaaaaggtccactgttcacctgttggagttttctttgtaggtaatctgcctcttctctctagttatctttgaaattttttctttcatgttgaccttgaggaatctgatgactatgtatcctgaggctggtcatctgctacagtatctcacaggggttctctgcatttcctgaatttgaatattagcctctctagtgagtttggggaaattttcatgtaatcagtctactcttatctcatgaaggcgttttgccatcttttattccctgtgaagttttcaagggtatatatcaagaagatggagattctgattgtttacacataatgcagacaattgtagttcatattaatgcctcatgatttataaggcacaggaagttaaatgtaaagtgcatgtatttaggtcccagaccaacaggattttaaaccttgacttcttctatttatcaacagagctattttggtaaaattgcataatcccattgtctcagtctcgtcatctattttttgaaaaagtaggaggaagataaagcataaaggtataggataaatcataaaggataaggatccagaatgtatgtaaaatgcctggctaataatagtctctcatgaatgatggtgatgttatgggaagatagcaggaagaatttttaaagttgggggtggggtatccaaaatgtttaacttctttgggcttcagtttcttgaccagtaagttgaaaacaaatcaaatgtacagtgttgtcaaaatagatattatgtcaaatatgaatcggtattatgatgcagatgatctgataaagaaggacctaggaaaagatggatttatgtcacatacacaaagaatagaagaaatacaggtatagtcttggagcacattaaagccaggacactaggcaacagaataacatgaaagacatggggagatagtgtcactagttacagcagcagagcaaaagttctccagatgtttcctcacaaacctactcttgagtcacactgggcagaattaagtcacgtggtcatccttccctggaaaggaacttccagggaaatgggtgttctcattttttcagccctatgagagatgacttggaatggctgttgggtagccaatcagaagagtcttgcacaattatacaggagacatgtaatgtaaaaattctcctaaaatttatttttccttctttttttgttttccccttagttgaggatatacttatcctaaaatgttggttgttattaaggcctaaacaaatgcaaaagagaattcctgatctacttcagtgctttcaaatattgttaagcttcagcatattttgttttgcttaaatattgcaatgaagcccaacatgtaaaatgaaaaaagaacagagcctctctagaagaaggtttgggggccccagagccctggcctatttattctattaatatttggcctcctgctgtctaacattacccctctccctgcagtcactgaatgtgctccaaccctacctagaatacagtccttatgatagtccacattcattcagcttccacatgtaccaggcattgtgctagacactggaatcaacttaaaaggtagataaggcctcagcctttatagggcttatttcccaggataagagatagacatatagatgctgggggaagggaggataataagtaaaatgaaagttgaattttaaaatgtccaagacagataatttctgtaggaaaaagaactaaggagtacagataaagcataactggaaggctgctggcttggacacagtgatcacagaagggccttctaaggcagagacttggagaagaaggacctaggcctgtgaagagtaagggagagggaggtcttatcggaaagaactgcaagttcaaatactaggaagcaagggctactagatgtgtttgagagcaagtgctagggcctataaagccttgaaaaccataggcagagactgggactttattcgagatgtcatagaaagcctcagaagataattttgaagggaagcataagacatgatctaatttacatttaaagaagatcatagaaatatttaaaaaaggaaaaacctatgattaatatttcagcaaaatgtgttttttggaatttataaatattatgccacatcgttatagttgaaaaacatctttaaagtcaaaaataccatattttttgaatacttaaacattatgctgaaaatgacataatgtagccctagctataaacttcatcttggctctgtttttccttcctctgctatttactttgaatagcaacttttctctcttactgaaaaactgggatcaagcctgaaacccctttgtctctgcagcaagtgtatcagagtttattttcaactaagctggcttcttgctaaaggcattttgttctagctacaaagaaaagatttcttccaagtattaccctttgattagatttgaactaaaaatgaattatattcatttatagtcttatactggggaaacctagatggcctatctcttctaagatcactgaatccactgaatctctctcccctcccacagctgtctttctctgtctttctctcactctgtctttatctatctatctatctatcatctatctgtcattctgtctatcatctatctatctctatccctctctctcaatcgctcttgtgttctgtttatgtaatagagtgataggtagataacagaggctgtcaataaaatggcctatagaaaaaaattgtctctctatttcacagaaaaactaattattttttgatttcttgaagaaatagctgttgaggatccaaacgtgcatctgcaaagctgaactaaggccactaattcatcagagcagcttacagattcaccagtcaattctaacaatttatatttttattctttttcctatgtttagtaattgttctatataagtttaatacagaaaagggacatgaatttttttcaaattgaagtattgcagaagaaaagtgtttttcacaatgatataagtatcttgtattgggtagttttatgtgtataagcatcttcagatattagaaaggataatttgatgataacttattctgaagagattttcatcaaactactttgtaagaaatgcagaggcatttttgattgttgaatctgtagacaggtgcgtaaaatccttatcgttgtaacagcagccctgctgaccagattggctgttattcttaaaagatgagggaagcacttacagcatcgtaagcctaataaggtgggtgttgtgaatcaatttgtactgtccttgactttctgcttatattagaattctaaaagatcattagccacctctgggatatgtttgattaatgggtttggttaaacaaaaaaggtgaggtcaaccgtgagcagaaagtttaaaaaaaatgtattccagaagaaacgtgtgcttcccaaattgcaaatgagaagttcattccttaggcatgttctaatcaatgaaaccatgtgttctactaagttgacctcaaaggagacttttagccaccctgcttatttgcctttcagttacaggaacgtgacttctgaggctagggtattagcacacctgctgaaacggtgttaatctaggtaatacaaagtccccaaacacatgctgttaataaggcaggtagtttaaaaaaaaaaaaaaagactagtctaatatctcacagtgagaaaaaattcttctctgtcattagagagggtgaaacatgctcctgttcttttgacattatatacctcttattgtttttcctttttattaaaaatgaatctcttctgctgttttcagcagtgcatttttacttctgtattataatagctctcctctcaatgattccatgaagacaggctgggataatacaccaaggaaaagattttgctttacttgccaaaatgagaccatactttgttttttccttaaccattgcccccttactccctggagtttatcaccccacacaaattaagctaattttataaactgaaaatgctctttctattaagttctcctcaaagtgaaagcaatgagcttcattctgtttattacactgctcttcacaattagttttatgatgtatggcaagaatgtgtatactataaatcgagtctataactcttacatatctagtgatagttatgaatccattgagtagaactgaaaatacagtatataacaactcagtttaatttataatctaaattgcaaagctatttagccccttacattcaaattcatttttgcagaccttttaattagatacagtgatctaaaataatctggtccccaaaggtaagacaatcaatttagtaagatcagacaatttctgatgctttaatacaaccacacaataccaccagctaacacctgactctcttgcttttatttcttttctttaagtaaatgaagtattaaaatgttgtgataatgcgaaaagagttaatacatcagaaacagctaaaaacatgaaatgcctaagtttttggctgaatatgggtcaaactttaaatgtgaaaagagctctctgctaccatcctctgcctgtaactgataacatatatttctgtcccttcataaagatctggaaacatggcaaagcccccataagagagagcacaatggatctcatttgaaaagttaacatttcaaaaatgagatctactgtgctccacaggcagttgagagaatgttctttatttaacctcaatgctcaatcgtctattgtaaccaaatagcagttgtttggttttttgttttttataacacccctttttttgtcttatttggtcctaactgacttcttcagaatgttgctgaacatctgcagagggagacatttctataacatatgtatttatgtttgtctaattggtacacatttgtttcatgatactttggtatgagaaaaataatttttttaaaatcaaattatattcaactccactcccaagcagcaaagttggcagaaaatccatactctttttttttttttttttgcaaagtttttttttcctgttgttcttgggattatattagatctagagaatcacagtgtagaaagagtgggaaaagaaggcttggtctatttgttcttgccagaacctgagtgttctatttgcaggtaagcagctctgaaattatgacatccatgtgctccaagccaaacatgatctccaaggaagcttctgtgaacaacccaggctaagggtcttgggatccagttctcctgaaaaccaggcaccacgtccctcagtgggctgaatcttcatgagtttcttttcatgaagaaaaacacaggtctccacctttcaaggaacccacacaccctgccataaaatcacttttacctcaagaagagctattcccctttccaagagtctagaatttcagtggagggacctcttacctttattcccagataaaaagtaatctgggtttccaggtctcaaagctcttggttttttagcagaggagaaggtaaaatgtttcgcattttttttttgtatggtaatcctacagccaaaaatagacacattttctggacggcttctcctgcataagtaggtagaaagataagtagtgtgtttgtttgtgtgtgtgcgtaattataaggcattttgggtgtaggatatatatagctgtacattctgtccttgatgaaaagacagaaaaatatggtgcatatttttaaaaatgagaagttcttttgtaataacagcatctcaggaatgagataaactagctattgaggatactatcatgtgagctttaaagtcaggctgactgccttattatttacccttaatttcctttagaccctatcttgggacccagaatatgaaagacactcaaaaaaaaaaaaaaagaagaaaagaaaatgcatgttaactttatttatttatttatttattttatgtgtttttattttattttatttttttgagaccgattctcgctctgtcgcccaggctggagagtagtggcacgatctcagctcactgcaagctccacctcctgggttcacgccattctcctgcctcagcctcccgagtagctaggactacaggcgcccgccaccacgcccagctaatttttttttttgtatttttagtagagacggggttccaccgtgttagccaggatggtctcaatctcctgacctcatgatctacccgcctcggcctccctaagtactgggattacaggcgtgagccaccgtgcccagccttaactttatttaaataaaacctccaaagtgggtgtaaccttcaaaagataaatacaaaataccaaatggagtgaatgatttcatctttacataaccacccctttgctgctattataatgtgacaatgtacattgcctgaatcagttgctccaacatgcacctctaggataaattattaattcctccatctggaaccctgtcttgcctctgtccctccttctccaaaagattctcaaatatggcataaatgcacaaaggaatgcagtggaaaatgcaaattctttattgttattttataccaaatttcaatgtattctctcagtgagttaggcagccttttttctgctttccctgtcacactggtgtagtcggcaagagttactaatataaggatatggtgattagccctggcagcaaaagggcttggttttgggcagcttgtgcccctggactggtcatatggagctgaaagcaatctccttcattaacactaagtgcccagaaaattgtgtcattttctgccataatatgataggtaaaacattgaggatgctgttggtaaaaggcaattccacagaaaacactccaagaaaccaaggcacagagtgcttccgtaaaaacatcattatactcctctcactaatattctactccctagtaacacagcccaatgaatgccccagacccaactcatctgctttctttggtaataaatttagtaaagagagaaattcttctgcactttatctatgggacaatgaaaatcatgggaaatggaccttcccaaacacctggacatcacttaacacaatcagatataagagtcttagaaatgttatcacttgcatctatacattctattgtttttttaaaaaattctgtacctagagatgatgtgtttattctctctcatgatttattacttaataataacaaaatcactgtttttgtttctttttttgagagggagtctcactttgttgcaaggctggagtgcagtggtgcaatcacggttcactgcaatctctgcctcccgggttcaagcaattctcttgccttagcctcccaagtagctgcgattaagggtgcgcaccatcacacctggctaattgttgtatttttaataaagacggggtttcaccatgttggccaggatggtctggatctcctgacctcatgatccgcctgcctcggccttccaaggtgctgggattacaggcatgagccacagcacccgaccaatcactaattttttttagtggcccagtgtctccctctctcttcttggcttaaataagaggtcaggaaaagcaagcctgggagaagagtcttttttttatttttaatattagagatctgaaaaggattttgaggtagacataaattggggccaaattataacagcatttttttccttcaataatctggtgggaaggaaaagattcctacgcgcccttcatcctctagccttgatgccagatcgacagccaatcacgtctctccacttctgaatcatgtctgaaaatatgcatgagtgcacatgcaataccatactagaaaacctttactcttcatcctagtcatttatttgcacaaataaatgtcttttcattctgccaattcattcactctttctcagataacaaaacgagaggtttttccccaacattatgactcttgtgttaatattgattccctctctcttagtcactttttcagaacaacaaactaattttatgtttttgcagtatgccttcatagcttcagcaagaatcactgatttggaactttgtcatatgctttcaaactatgtaagattcaggtctaagttgaatgcaacagtacagtatctcaaaaacttaacctagttattgaggcatgacctttttgaggttgctttgtgttttttctgtcagctttgttttttaagtgtctggttatttgatccctgaattgaagttttgagatttaatgactgtcagataacataacaatatcccggagtgtgtatatataccttggataagaatagccacatgagtttcacctttctttttattcgtaagtactatgaaatgcatatgtcagaagaaatcttttcttcaaaggcctatgtcattgaagctgcaaagaaacctttctcctgtgtataggcaattattattactttccaagaggcatatctgagctgtagttgcaaacatgtcacatgcctcttcaaagctacctttcctttcattatgacatgcactatttgggacctattttttttccaacagcactgtcacagttttcatgtttttagtctgcatttactaaagaaaagttgccaagatggttcgagcttatgtaaactttgctaagaataactacatgatatagtaatgtatgcacaacacagaggagtttaaagaaagggagaggaagggagaaatctccaatataaaaagggtgtagtctggtttgttattttttaccgtgcagaattattcatgaacgtgaattgtgcttgtttctgttctgtaggtaagaatttatttaaacaggtcaaacttggaggtccctatagtacattttaaaagggtgaagattatagtaaatgaataaccatgtatagcactcatagaaaaatttttaaatgtttctattatttcattctgttttgttcctgattataaatgttattgctatagtgctttatttagtaatctagaaatatcaattgttctaacacaaagcacaaatacactcttatatacaaacaccgtcttgcaagcaccgaagacagaattatatcaatgactttatccatcaaacaaaatttaatattactttaaaggttgttacagaaactataagcattcctaaattttccacctaacttttcttcatttgttacataatggcaccaaattaaagacttcgagtgttgcagagagggtctgtcccatttctgcctctttaattgaggattctttacacagagagttccctgagttgttagcaaattgaagttagctgcaaatatccatggatatttcaaggtattttccacagtccttattccccttatctaaagtcttgatcctctactttgtgttcctgaaccaaactctggttccatttagagttttcataacgcattccctctgtttagccttatggctgatactgaagagatgcatctttgggtggaaaactctctttttgtgacctagcattaataagatgccctctgtcaggggaagctcttgtgaactgagaagctcggctttctttttattgattaaagcttgtaaggaataaaatatcattatgaaggcataaattaagaagacttgggataggagaaatgcagaatttcattttggtttatttctgaaaaataagtgatccttccacctcagcctcctaagtagctagcatgcccagctaatttttaaatttttattttgtaaacatgggatcttgctatgttgcccaggctgttctcaaactcctggcctcaagcaataatcccatctcagcctcctaaagcactgggattacaggcataagccaatgtgcccaccctattttaccactgtttctggagataacagtagcctcaattttctgagacttttaaagattctgcaggttagttcttgtctttcacaattgctagttggggaattactttccagggtcccctaattctgttatcaacaattaatctacttccaacttccaattttttgtcctttacaacctcgtcagtttatggctaaaatattattttgtttattcctctaaaaagagatttttctggtttatttgcttttgtttgtaatacagttttaaagtatttttcttagaagtatgtgaaacatgatatactttctgatattctggatattctaaactaattttcatttgctctgacaaataactttaatctgagattaatataggaatcctaggttttaggtttctacttcctcacaatagccttgatatgcaattccactgttgcataaagaagttcaatactctgccgatattatatattctttgtagctaatgtttttttcttcctagaagcttatatttctctttaatcttagaatttaagaataataccaaggtttgcttggatgtgtgtcttcttaccaatctaacggcattcatgggaccgaggtttctgtgttatccagggtcccactcctccatatgctgcccaacgtcaagctcttcctcgatttgccatccctggtcctcacactagggtcatggtcctccctacctatcaaactcaatggaaagttttttgttttaaagataaaatctcatatgaaattggagcaagtaaaaacaagaaaataagaaaaagaaagatagttatgaaaaatagtccagttttcccaacatcctgttaataggaactcaagaaacagaaaatagagagaaaaacaaatcataaataaaataattcaagagaatttgtcacaactaaagtttccaactcaaaagatctcatttgatgcccaacacaatggataaaagtagacccactccaagacacataatcttaacattttagaaacaaggaacagaaaaaaattatgtaagatttcatagaagaaaaacaatggatcacattaaaaagacaaagaggtattttcagatttctcaacagcattagaagctagaaaattatttacgctaaagaaaaattatgtcccacttaaaatctatatcaattatctgtccaatggaaaggtgaagacattttcagacctccaagttctcagcaatttcaccttccacagacacttttccagaaatctgctagataatatgctcctctgaaactaggaagaaaagaaaaaaggaatgcatgagaggctgataggaataggagaactcactgagaaaacagtccaaaggaatccccaggatgagcatgaaaagatgtgtccagaggactgttgtgtgccaggtacagtagaaaccgacctagcccagggtgatccaggtctgaggatctagaagaggtttctttaatattaatttgatgatgaggagatgtgaataattgacaaagcgtttaaggttgaacagtaaaatgtatctagaaaactaaatgaacaaaaattaagtccataccaaaaaaatttgtgttttttaagagagaaaatgtaataatcctagttcactaagagatttaagttagagcatgataatgatgtaaacactaagggctccaactaaacctaggctgcaacataattaaaaaggatacaataagacaacaataagaagtgtgggtggcagtagaggagaggcaagaaggataaaggctaaatccttatcctttattgtcaaaaatcaatgcacgaaactgaaaaactaagtaacaatgcaagcaagttttactgagctatgaagataaatacccgaagaatcaactaaaaaagttaaaaaggagtgcttcagggaaaaagaaacgtgaatgctctgaactgatgtatttcttaacaaatcttatagaactatgtgctctttaaactacagatgtcgattatgtgatcatatgtatataattttaaataaaaaattagaagaaagatgaaagaagaaagtaaagtagaatggaggaagaaaaggaggaaaagatggataatgagataagataaaatagaaactatccaaaagccagaaggaccatgtttttattaaataggaattttaatattaaaggcatcaatcagaacaccaaattacataaggtacctactaaaaagaaccaagttacagttgtgttttgtaatctagccaatcaatatccttccattcagctcctttatttcttttctatggaaaaactcaactaattttccagctttcttgcaataaatttaattcttggctgacattctaccatggccagaatgcaagacactatcttccagtcttgtccattcagatagcctttttattgttctaacattgtgtgtgaactaggttttggtctggaaggcaattttttcattatttcagtttgggccttggtccatcttaggccagtttttcattttgttaatttttgctttaccattatgtctcaaattttattcatgagatattttacacatcaattatattttgcatgcattttactttaattcatccagtataaattacttccatttagaattaatcatggaacctatacagtttaggataatgtttccaaaatttctaaattaacagaagcctgtacttgacaactatatggatcatccaatataatttaaaatgtgatatccatcttaggaatttgcatatatcactgtgttgatcagcacactttttcttacaagaacataaactcttctagcttaagcaaaaattaatttaagttcttttttctttggacccaaaattgagttgtatgatcaaatgcagaacttaacaggagtgcttttttgttgttgtttttgttttttgtttgtttgtttgtttttgttttaaagctgctttatttttctctaggatctcataatttcttatttccacctctcaggttacaattgtgtggtttttggttcttgttattggatagatccatctttctctgcttttccaaccatccacctagaaaaaaaaaatgctctcctacagtttttgagcaaccagcgtacaggtagtctgaagagactcattacttctgcaaaccccaatttcaagttcctagaagagagaatctgaatcagattgaatctgaaatccatggagtctaaacattgacctctaaagtttattactggcgtatgaaaaggcattttttacagagggaagacaaacattgaggagactaacaagtatctactgctctgcagtaaataaatgcaattagatcatacaatgtgttttagtactttctaattcattattgacaatgttggtctgtattcatcaccttgttttccttggtagttttttttttatttttttgttttttcttaccaggtcttttttttcttttatttcaacttttattttatattcagtgagtacatgtgccagtttgtaacctgggtatattgtctgatgctgaggttttggagtaccactgatcctgtcacccaggtagtgagcatagtatccagtagtaagtttttcaaccctttacgccatcctctgtcctccagtatttctcaaccaaaaaaagaactacttttggtttcgttgattctttgtatggatttcggggtctcaatttctctcagttcttctctgtgagtttttagtattgtgcagtgctctatgaaataaagaaaaatatactcactacatgctgcctacattatagggacataaaaaaaactttcaagcaccctcatcactctatatatttcttatattgtttgactcttttactacccttgacctcatttctcattatctactgttcccatctttatgtccgtacatacccaatgtttaactcccacttataagtgagaaaatgcaatatttcctgattaatttgcttagaataatgcccttgagctgcatccaggtcgctgcagaggacatggtttcattatttttatggctgtgtagtattccatgctgtgtatgtaccacattttctttatccaatctgccgttgattctacgtgtctttgctattgtgaatagcatcacgatgaacaaaagactacatgtgtcttttcagtagaatgatttattttcttttggatatatacccagtaataagattgctgggttaaatggtagttctattttaagttatttgagaaatctccaaactgctttccacagtggctaagctaacttacattcccaccaaatgtataagcgttcccttgtctcctcagcctcaccaatgtctgttgtgtattgactttttaataatagctattctgactggtgtgagatagtatctcattgtggcttcgatttacaattatcttatgattagtgatgttgagtgttttttcatatgtttgttggttgcttgtatgtcttcttttgagaagtatctgttcatgtcttttgactaccttttaatgggattttttttcttgttaaattatttaagttccttatagattctagacattagacctttgttggatgcatagtttgcaaatattttctcccactctgtaggttgtctgtttactctgttgatagtttctttggctgtacagaagccctttagtttaattagatctcacttgtcaattttagtttttgttggaattgctcttgaggacttaatcataaattatttgccaaggttgatgtccagaatggtgtttcctaggtttttgtctagcatcctcatagtctgtggtcttatattaaaatctttaatcgatcttgagttcaattttatgtatgatgaaacgtaggggtcagtttcattctactgcatatggctagccagctatcccagcaacatatattgaatagaaagtcctttccacttgcttatttttgtagacttagttgcagatcagatggctgcaggtgtggggcttcatttctgggttctctatcctgtctcattggtctgtgtgtctgtttttaaccatgctgttttggttactgtagccttatagtatacttggaagtctggtaacatgatgtctcatggcttgttctttctgtttaggattgctttggctcttcaggtctttttttggtgccacatgaattttagaatagtttttttctaattctgtgaaaaattgcattagtagtttgataggaatggtgttgaatatgtaggttgctttgggcattatgaccattttaacaatactgatgagtatgaaatgtttttccatttatttgtgtcatctctgatttcttgcagcagtgttttgtagttctctttgtagacatctttcacctttttggtgagctgtattcctaggtaatttttgtgtgactattgtaaatggcattgcattcttgatttggccctcagcttgaacattattgttgcatagaaatggcactaatttttataaatttattttgtatcttgaaactttattgaaatcatttttatcagtttcaggagccttttggcagtatcattagagctttctagatgtagaatcatattgtcagtgaagagagacaacttgatttcttcttttcctatttagatgccttatatttatatctcttgcctgattgctttggctaggactttcaatgctatcttgaataggagtggtgagagtgggcatacttgtcttgttccagttctcaaggggaatgattccagcttttgtccattcaatatgatgttggctgtgagtttgtcatagatgactcattattctgaggtacgtttcttcaatgcctagtttggtgaaggtttttatcatgaagggatgttgaatttcatcaaaggctgtttctgcatttattcagatgatcatatggcttttgtttttaattctctttatgcagtgatcacattcattgatttgcatttgtcgaaccaacccagcatcccagtaatcaagcattcttgatcttagtgaattaactttttgatgcgctgtggattcaacttgcaagtgttttgttgaggatttttgcatttatgtttatcgggatgttggcctgtgttttcatttttcatagtatctttgccaggttttggtatgaaagtgatgctggcttcatagaatgagttgggaagaaatgcctcttccttgttttttttttttcgaatagtttcagtggaattcgtatcagctcttctttgtatgtctggtagaattcagctgtgaatccatctggtcaggagctttttgcgttggtaggttttttattactaatttatttattcaattttgaaacttgatactggtttgcttagggttccagtttcttcctgtttcaatcttgggaggttgtgtgtttctgggagtttatccattttccctagattttctacttcatgtgcatacaggagttctataatagtctctgagaattttttgtatttctgtaagattggttataatgttatctttgtcattcctgattgtgcttatttggatattctttttctttgttaatctagctagcagtatattgatcttgtttatcctttcaaaaaaaaaactacttttggttttggtgattctttgtatggatttcggggtctcaatttctctcagttctgctctgtgagtttttagtattgtgcagtgctctatgaaataaagaaaaatatactcactacatgctgctacattataggaatataaaaaaactgtcatgcaccctcatcactctatatatttcttatattgtctgactcttttactacccttgacctcttaatcactttcttgtgactacttagttggtttattattataatcaaatcaacatcagtattcttttatatgtacattttccattcacttttgctgataacatcttgtctgttagtgtttatagcaactgcttcaaatctttttcgaaatgagaaagcatacaagcatacatctgaatgtaaataaatcagtcacaatctcaagtcctactgatgtctcttttttcaaaatatttaaccttggattaaattttttatcaagtatttaaactctgctgcaggtaggctgggcacgatgactcatgcctataatcccagcactttgggaggcagaggtgggtagatctcttgagctcaggcattcaagaccagcctattctcttggaaacataattacaaaaacttcattccttgccctggccgtttctttaaccaaacttcagcttctttgtgcccataggtgctggcaagcagagatggtatatctctgaatatgcgtattgtcagtgtctctctgtgaatgccattattcaagggctcacaattgatattgttctttgttgcagatagtgacttccaaagtgaagtttttggaatgctagtgctagaagactttcttaaaaacaaagatttcatagcaaagtaaacttttttatattttcctaagaagaaaatgtaacctttcttggtaatttttgatgaatattaaaagattttcaagatccttcatttaaaaaaaaaagtacctactttgtaatccacttttctgttgttactgaactggagtgcacacgataattttcccctgacctcgtatatgccacaaagattctgatttacactctgggagtcacagccttcttgatttaccaaatccttatctaaacacacaaagacatccactcttccaaaaaatcacttttatgtacagcaatgctgttagtaaagttgtgtttgtctatctgtgtcttgtgtgtgcctttgtgtatgtctctgtgtgtggtgtgtgtctgtgtgttttcttctgttttaatttgtggttcatcaagaggaacaaattgttcagtacacggaagaaaataactcatttacttttttccaagagtcagatttgaaggatttttgaaggttcctaagataataaatttattatttatggacaagcattttatatcattaaaaaagaacaaattttgttagtcttataatgctttaaaaatgcagaatttctcatgtgagaatcggaattgaattttggtatgagattatgaaattattaattattaatactcttttggtgaaaaggaatatttaaatatattttgagactttaccctctatgtgacaagcaacttttattacttttgcatttaattaaaatttctaattacatttttatctatgataaaaagtacaaaatttaaaattcaacagttaccactattaaatttgaagcattttcacattacagtttctgctgcttatacaccaaccatcaatgctattatggattatcacttcaattaaaagattgtttatgatccccataggtatagatagaaatgaaggctgagcaatgggaattccaatgatgatgtagaacattccatattaaataaaatcctgtgcacctgggaaatcaaattttagctcagttgtatttattatgacaccctaggacttgtgttttatggattcaagataagaaaatcattaaaaatctgcttgtcacattaagagatcatttaaaattattccctcagggattattattagcaatatattgtaagatcttttccttccttgaccatcttatctttatgtaacacatgatttctgtagttaactagagaattcagtgttcaggaagattatgatgctgggaaatcctcctgagacaatttttttcatcactgagattttcccccaaataggaagttgtttttcttttttcaatctgcaaatatcctcactttttctcaagccactttcattactgtcagtcttctgcaggttttcaccacacctaaaaagagaaaacataaccattacaaacctaaaaagactcaataaaccaaagtaaaaagtaaaaccttgagacctgaggtcaaagaatcaaacccaagtaagactggagttttccagtgaaatacttggaaatctaaaattcaaaaccaaggtcatggtgtggaaggacattaatatacattttatctttttataacaaatcatctctagggaaattttcctactagaaatcgtaattatctccatcagtcgctccagggcagtatcggcaagctgataatgcacctgcatctctaccaatcacattgccacagaaactggaggggaaaaatctgctgctcaagagttctatctctgagcctgtgaaatagccattatctccatggcaatctgtatttaagacagccatccaatcctcatcttttcttttttacagtttacttttaagctttcatacagcttcattctgaaaaatattttctttaattacttttcctttattcctccaactcaacatatatatatataatacatatataaataacgtatatgcatttccacaaagctatcttgtttttatataattagagggaacttatctttctgattccctctaattatataaaaacaagatagctttgtggaaaagcatatatgttatatacatatatatatactgcatagaaaatataactgatatttgagtaagtatgtaaaagaaaattggccaacagaaaataaaattcttaagaaaactaacaagtagtggttacaataatatatagagatgcaatatatataaactgtatgaaaaatgtaattgacaattgcatagagtcattatgtaaatgaaacatcaaccaatgaaaaacataaaattctttagacatttaacaagtactgattgcaacaaaacacagggttgtttttttttaacttttttgaatatgtagtaatttttttttttaaatggagtctcaccctgttgcccaggctggagtgcagtggcatgatctcggctcactgcaacctcctccgcctcccgggttctagcaattcttcttcttcagactcccgagtagctgagactacaggcacacaccaccatgcctggctgattttttgtattttagcagagactgggtttcaccatgttgcccaggctgatctcaaactcctgagctcaggtagtccacctgcctcagcctcccaaagtgctgggattacaggcgtgagccactgtacctggccagtaattttttgatgtttgaagttctactaaaaaacaaaattttcattacaataatatcagttgttaatgtttttccgactgtcaatatcattatttaactactttcttttcttcactcgatctcatagttctattcaacctgctaagaacaaacagtatctattcaaccatttcaatcatcaaagtaaaatttcaggaatattattcttgtaaaactcatgtgtggacaatgtttttgtgaagcaaaaccagtgtgatttgctttcaagattccctccagcgggttctgtttttgttgttttgccatacaagtaatgaatgtgtctgaatataaaagggataggtaatttaagaaagaagtacatctttaataaagtactgaaaagttttgaaaatatcacactgataaaaccaaacatatctgaagccataattcataatggaattaacactgtaagtctacatcaatgttttaaatattttcagtacctagaaatatatggtgaatatgtggtagtgaataagtctcatgaaacctgatggttttataaatgggagttccccttcacaagctctcttgcctgctgccatataagatgtgactttgttcctcttttgccctctagcatgattgtgaggcctccccagctatgtggaactgtgaatcaattaaaccacttttctttataaattacatagtctcaggtatgtctttattagcagcataagaacagactaatacagtgaattgttaccaatagagtggggtgctgctgtaaagacagccaaaattgtggaagccactttggaactgggtaacaggcagaggctggaacagtttggaagctcagaagaggacgggaacatgtgggaaagtttggaacgtcctagagactttttgaatggctttgaccaaaatgctgatagtgatatggacaagaaatctaggttgaggcggtctaggatggagatgaggaacttgctgggtactggagtaaaggtcactcttgttatgcaaaaagactggtgatattttgcctctgccctagaggtctgtggaactttgaacttgagagagataatttaaggtatctggcataacagatttctaagtggcaaaatattcaagaggaagcagagaataaaaatctgactatgcaataaaaaaaaaaagaaaaatccattttctgagtagaaattcaagccagctgcaaaaatttgcataagtaacaaggagccaaatgttaatcaccaagacaatggggaaaatgtctccagagcatgttacagacctttatggcagccccttccatcacatgcctagaggcctagtagggaaaaatggctccatgggctgagcccagggactcctgctccatgcagccttggggcatggtgccctgcatcccagctgcttcagctccagctatggctaaaaggggcgaacatacagctcaggccattgcttcagagaatgcaagccccaagccttggtggcttacacgtggttttgggcatgctggtacacagaagtcaagaattgaggtttgggaacctctgcctagatttcataggatgcgtggaaatgcctggatgtccaggcagatgtttgcttcaaggtcagggccctcatgggagcttctgctagggcagtgtggaagggaaatgtggggttgaagcccccacacagagtccccactgaagaactgcctactagaactctgaaaagagggccaccatcctccagaccccagaatgatagatccaccgatagcttggacagtgcacctggaaaagccacagacactcaacaccagcagctgagaggggggctataccctgcaaagccacagggcagagctgcacaagaccatgggaacccacctcttgcatcagtatgacctggatgtaagacatggagtcaaagacaatcattttggagctttaagatttgactgccctgctggattttgaagttgcatggggctggtagccccttcattttggccaatttctcccatttggaatgggtgtatttatcccaatgcctgtacccccattgtatctaggaagtaactaacttgcttttgattttacaggcttataggtgggagggacttgccttgtctcagataagactttaaactgtggacctctgagttgatgctgaaatgagttaagactttggggatctattgggaaggcatgattggttttcgaatgtgaggacctgagatcttggaggggccaggggtggaatgatatgtgctttggctatgtccacacccaaatctcactttgaattgtaattatccccatgtgtcaaggacagggccgggtggagatgattgaatcatgagggcagttttgcccatactgttctcgtggtagtcagtttcatgagatctgatggttttataaatgggagttcccctgcataagctctcttgcctgctgccatataagatgtaactttgctcatcattcgccttctggcatgattgtgaggcttctgcagatgtgtggaactgggagtcaattaaacctctttcctttataaattacccagtctctgggaacaggctaatacatagtcctaaacttcataacttatctaatgtagctctccccagtatgactaaccaccacactccatattcacctccatctgtttccaatatgtcccatccttctcaaaaagaagtgtctattctctgtatttaggacatcacttatgaggtataaattattcatgttatgcttctcatctggagtgttttctctccagtccatagcagtgttcaaggcctaaaagcagaggtgacaaaaacagtctgcctgcaaatgaaacatggctcaaagacatgttttttatggtccacacagtagccaataacttaaaaactgaaaatttttatataaaaatccagattttcatctttacctgaacacctagaacatgtggttgcactgtcccccgtggcaatagttggctggagctaagcagctctggaaccttcttggtggggcagtgtatgtactccttggtctagcccagttttcatttcttcttatttcttagcctgggtccctataggcacttcaacttttgatctctgacatgcaagaatgaaattatatagcaaagagtagaaaatctttgaacactcattcacaagggaaagtttcaacattattatagcagtacctaatctaaataaagtcaaccacaaatttatttatgtttaataaactttattactacaacttattcaacatttattgaatcctgttttgtaccaagaattagatgaggaaatgtggacaaagagcagagtaaagtatatttctgccttcccataattaatcatgtagtcaatataacagaaatcattttaaacaaggtattttaatacaatgcaataacagagatatatacaaaaggcactaaaagaaaatatctgagcatcagctgtattatattcaaagagccaacttatccatagatgttattaatgaatagatgacagatttgatggcttacatcaatttagtttttacaagaggaatataaacacctgtgtcataattgaggactgcaaactactcaaagtcataattgtaattttgcatgacttgtaaaatgtctgcttcagtaatcatgaagcactaagaaatcagtatcacactttagaatataactaaactttttattcctaacctattatttacctgcctatcttaaagaaatatcttggatgtttgagttaagtatctgcttgataaatgttatataaatcagttgctacaggcatcagtgttttggatatttttcaaatatagtgcgactgtttatttcaaatttaattcaaataagatgtattttgaactgtctcaggttaaatttctggaactttatggtaacttgaaggaatttaaaagtaggaattattacaattcaaactcatattaatctaaagacaattctgagctttagttttgggttttttatcaaggcaagatcaatctccccctgaatttgacccattaatctgtcttccccccttaaccacaccctttcaaattttgcatatttgaaaagagctatcataccttcctcacaaatatacttattcaataatttcctgtttagattactcatatggctctattatttttctgcgaactttcttctcaaatgttgccctgtttttaaacattccttgtaaaacatagcacttagaaacaaatgaagtattctagattgtggatgatcagatccaagtttggcacaattatttttcttgatgtagacaatattatttttgagcaagctttatatccaataacatttctggtagcatatcatacttcagatgcacattgaacttaaattattcatttgtttcttctgagtgccatatttggcttcatccactaaaccatatgataattatttggtacatatgataaacctatagttctaatgacaacatttctgtaaaagctatggatttcagattccttgaaataaattttcagtccacctttcaagcactgtcttcattgagtataacactcactcagtacaggatacttttcatggtatagagtccctaaggaccaaggagtcctggaatcatatgtaatctcatcacccaatcatttgctctaccatacaactttatgatattgttttaaccaaaagtcagattcactattatagaaattaccctattgttggaagttactaagataatggtcattagtctgatgtcagagaggaaaatccaaataatgacatgtcattgtttatcttattgataactgcataccactttatactgtaaataactgaaaataaacatttcttaaagcttgtagtagactgaatactggtgtcccaaagatgtccatgtcctaattcccagacctccaaatgtttccttacatggcaaaagggactttacaggtgtgatttagttaaggatcttcagatcagaggattcctctacattacttgggcaggcccggtgtactcacaagagtccttaaaagcagagaggagggtcagggcagagaaggccatgtgacaatggaagcagaggtcagagtgaaatggggccacaagacaagaaacacaggcagcctctagagctggaaaaagcaagaaaatagattcttacccacagccttcaaaaggagtacagccctgcttgcccattttggatttctgacctccagaacaaatgtgtgttgctttaagtcagtaagtgtggtaatttgtaacagcagcaataggaaactgatatgcttcttaatcaaaggctcctggtaaaaactgcactcatctaattagactttgctgggggtggaataaaacacaacttctatttatcctgacagatattaaagaacataaggcttttttcttcttcctaatagtggctttaatagtttgattttttttcaactctgctacactttacatatattatatgggaagaaattggtacaatgagtctaattttctacagatttgtcaagagtatttgaacagtaaaacatatttccaaacaatcattagtttctaacaccaaaaactgggtaaacagccaaactaaaatggtattaaaaagactcatcattctttatattaattgctaactcattaatcaattactaattcagaaatacacagattattaggtattgctaagtgataacttgtggacttaaaggtaaatttgggtaaggataaaaaattaaaacttggtttagaataataaaatgataccaaatcagaatcagaatcacacaattccaatgtttagaaactgtaaaatttatactaaaaatatttaaggcattatttatcaagctaacacagttctaaataattgtacaatgctttagacaggaatagaaaatcaataagctggaggtttcaaccattcctgtcatggaacattttaagatttatgaaataaaattgatttgtgaaatcagacagaattgctgtatttacctttcattaacatgaatgtaactgtgccactagtcaaaaatattaatcacgttgattatccttaagcaatttcaagtttattattgaaagcataagtattcattttcccaagtattcaataagactgcctgtcaaattacaaacaacacaataaattctacaaagtgtggtgaaacaataaaatcatttaacataattgaatattcccatgaattgtataaacattaatcttaatgataaatcaaaaagcaaataacttattgggtaaagttcttaagttctacatctagctctgtcactaacaacacttcttaaatccactgaaaataatctacttctaaccttgactctgttttcattaatcaccacaaggactctcaagtcaccttagtttcccatgctttaatctcctattggaccctacgcatacttgatttttgtcctcttttattacccatccctgattcctaaaccttttctattgtgtccttcaggaaccatcatcagaagaatgccttatatcctaaaattagtctatgaatattctcttcactttctttctttaatataactggctttccttcattttccaagcagtggctcatgtctcccatagtcattgttgcaataacttcactattcgcagaagtgactgaaaaccacacacacatgcacacaaatcacatcacaaaaagtaaactcagtgtatccttgacatgactttgtaagatctcaaaaatacctatggcctctctccattgctgtccaacaaggagacaagtattgcagacaagaagctagattggcagagagtgatcttaactggttgtggtcaaaatagtttacttctgtaaatatgtcaaaagcacatatccctgtgaacatattggtaaagcccctcccaggaaataagctcctgtaaggaagtggggtggggcaggggagctagaattcaagcctcattagttccatgaagaccccacaattgcatgcatcccactctctgaccaccacctcctgcgttttctctcccctctctctggtacctcaatgacacattttagtttttagcttctcattttaaaacaatttcagactcataaaaagttgcagaaatagtaaacacagttcccatgtcttcttcactcagcttccttaaatgttaacatcctacaaagccagtataattatcgaaatatagttatgaaagctaggaaattaagattggtgcaacaccattgacaaaaataaaccttattcaaatttcatgagttgtctcactaatatttttattttttactatggaatttaatctaggatcccataattaatttaattgtcatcttgcctctaatttgggacagttcttcattctttctttgactttgatgaacttaacacttttgaagagtactgaccatttattttgtcaaatgtccttcaattgggtttgtcagtatttcatcatgattaaaatcaagttgtgcatttttcaaaataataccacagaagtggcgcgcccttctcaatgcatcatatgaggtgctacatgatgttggtttgtcccattattgctggtattaactttgatcatttggtcaaggtgttacatgcagatttctccactgcaaagttagttttctctgtgtaactaatatgtatctggtagggagggagactataaatattccacatctcatcatattttgtcaactaagtttagcattcatcgatgattcttgcctgtaacaattgttactgtaacgtttgccaactggtgatccaaaactctcaaccctactgggacctccattccgttgatctttccgatgttactctatcctcagcattttcgtttcctcacttccctctatgtgtagcttaaattcaattctccatcattataattaccccttgcctatatcctcaactcattttctcttcacttgtttcactgtatttctcgttaaaaccacagctcttcacctactctttgcctagaactatggacttgagatttgctgattaaaaaatacataagcaaattaactggtttcttttcaaacaatgttcattacccctagagaatccctaatattgtcaggtaattatactatgtctttctagttcattattactttacaactcttcacaccttcttctctctcctccagctccctgtacctccttatccatttcccctctcagctgatgtccttgtttcatattttctgagaaaaatatgaatcaacctaatcagactttgaaccagctcccaccataatatctacttgctggcatctgcactcacactggctcccactgttaccataggtgaaatttctatgttttaataccatgtataaaagcttatcctttttcatctactcaagcacattgctccagcagtttctctcacttttgcatcatcaaagttttctctatattagatcatgccaacagcttacattttattattcctgtcttttttaaaaaaaatctttcattccacttttcccacatgttaccaccccattactttgctcctctttatagcaaaactcttcagaaattgttttcaatggttactgtccccaattcctctccttctattcactcaaatctatttcattcagatatttgcctctattgttcactgaaactgatcttataaaagtcatcaaaaaaccattacattacaaatgcacagttagttctgagtactctttttgcttcacctagtagtggcactcatcacagctgaacattccctcccacgtgtcacagtgtgttcacttactaccaaaggaaacattctgtgtgtttcttctgtttgaccggatgttctgcctccataccttttactcattcaagccttcatatgttgaagtgtcccaggttttactcattctgatgatctcatttaatctcatgtctttaaatgccatttatatggtatattagtcggcttgggctgccataacaaaataccatagactagatgtctttaaaaagagaaatttatttctcaaagttcttaaggctggaagtcccagatcaaggggtcaccagagctggtttctcctgaagccactctccgtggcttgcagaggtcagcttctcgctgtgacttcaaatggtcttttctccatgtgtgtgcacccttgatgtcactctatgtgtccaaatttcctcttcttcaaagaacaaatcagattggtttaaggtcctccctaaagacctcattttaagctaaacacctttttgaaggccctgcctccaaaggtagtcatattctgaggaactgtgagtttctccacttcaatatatcaatttggggaagacacaattcaggcaataatatatgacaattccaaattttatactgccaactcagaccttcctccccaaattcagattcatatatatgatagttttaacatctctcatgaattttatcctggaaatccactctccccacagccatctctgtcttgggtctcagtaactccattttaccatcctttcgtgatcctggtcaaaaaaccttagaatcctccttgaccctctcttctctaactgctcacatacaatccactagaaagtcatgtcactctacctgcaaaatatatttaaaatctgatcctttatcattctcttcactgcaatcacaatgaactaagtcaacatcatcttttgcctggatttctgcaatagtttcccaggtcttcctcttgcttctttgtagtccattctcaaaacagaacccataagtgatctttttaagacataagtcagactatattactcttctattcaaaatccttcaatggcttgacgtttcacttggagtaaaatgaaaagtccttacaaggaattacaaggccctgccagttctgggcccaactccctatccccttaacgctctgacctactcctgtgcttctcacatcagcttactacacttcagccaaactgacctcctcctatcctaaaacacaccagtcatgctcctgctttagagcctttgttctggctactactcgatcattcttctggacaaactgctaactgcatggctcgctccttcaccttcttcaagacttggtttaaatctgaaccttaccaatacaccttcactgacaattggctactgctcctaagccctgcccaccctatcccaccaccctcaacctggacgttttctttattcatgacattacttaccatttatgtaacatattatcaaatttacttattcattatatttatttttattgtttttttatctgtcttccaaaataggaatttaagtgctctagtgcaggaatctttattcattttcttccctgatatattcaaattcctaaggaagtgtccaggactttataggtgctctttaaatagcaagaaaacaaataatgtgattgaaaaaatgggcggaggacctgaattaacttttgcaaaagaagatatacaaagggccaacaggtatatgaaagagtgctcaacaacactaatcatcagggaaatgaaaattaaaactacagtgaaatatcatcctacatctattagaatggttattatcaaaaatacaaaaagtaagtgttggcaagtatgtgaagaaaaggggacccttgaatactgtttgtgggaatgtaaattagtacaaccattgtagaaaacagtatgaagcttcctcaaaaaatttttaaaaaaaactatcatatgatccagcaattgcaacactgggtatatattcaaaggaaatgaaattcatgtgtcaaagagatatctgcacttccatattcgttgcagcattattcacaataactaaggtgtggaatcaacctaagtgtctatcaaaaaataaatggataaataaaatggtcattatatatatacacaattgagtatgattcagccttaaaaaagaaagaaatcctgtcatttgcaacaaaatagataagcctggaggacattatgtgaaataagccaggtgtagagagacaaatactacatgatctcacttatgtggaatcttaaaaagtcaaatttatagaagtaaaaaatagaatggtagttaccaggggtggtgggagacagggagagatgtgatcattgaatacaaaatttcagttaggaggaataagttcaagagatttactttaaaacatggtcactaaagttaataacaatgtattatatatttgaaaatggctgaaagtagcttttaagtgttctcaccacaaaaaaatgacctatatgtgaggtaatgcatatgttaattagctagttttacccatttcactatgtataaacatttaaaaacatcattatatacaccataaatatattccatttttatttgtgaattaaattttaaaaaatttgaatgtatgaatgaatggatgaatgacaagcctcatgcatgtcacttattgagcctcagaccccttattttcataattacaaaggttaaattatataatttctgttgtctattctaaccaccagcatttgattttatgatactatagatcttacttagaaaaaaaaatagatatatagaaactcacctttacccaacagataaatttggttattttaaatgttttttgaagattcttttgtaaaaaaaaaattactgctaatgcattatacattcattgggagtctttgacacagaaatggggaagaatagtcacctcagctgaagtagatgaggtctctgacaactgtacgtcaaaggcaaatgaagataaaataccttcaaaatgatcacataaatcaataagcaaatgactttgattacaactatgatttaattaattataaggccacatctgttgcattaatcaagctaaaatcagtaacagaatttaaattgaatgtggtacctcaggagaggttttaaaagtaaactttttattaaggaataaatacagacataaaagtgtacaaatcatgcattccttgtttggtgaattatcacaaagtgaatgtattcatgtaactattattcagatcaagaatcagaatattgctagaatattaccagcacaccagatgtctccctaaagtccccaactagccactgactccccagcttccaacaattcccactatcctgatatctaacttcatagattagttttgtctgggtttcaatgttctataaatataatcacacactgagtaatcctagtgtctggcaatttttgttaaccattttctgtaatatttatttgcatcattatgcacagttgtaattcattcattcttcttaatctataatcctccagtgtattaatatacccagttgattttttatactgctgatggatattttgggttgtttctagtttataactacaatagtagtgctgctttttgtatatgttatttgatgaacatttctcttgagtatatattttcaaggatcactactggtcatgaagtatgcttatgttcaatcttagtaaatattaccaaatggtttcccaaactggtttttccaattatattcctaccttcaatatatgacagtttcagttgtttcttgccttcttcaaaatttagtattttctatcttattttagttattttggggtatgtgtaatggtatcatattggtttgatttctatgcatttgtgtggttttgaaattttatatgtacagtaaaatgcacacatctttattgagcttgataaatttatatgtatatgtgtatgtacatacacacatatacagtgtaggtgtgtatgtgtgtatatgtatatgtgtgtatgaatgtatgagtgaacacacacatatacatatacatatacacatacacacatacacacacacacaaacctatggtaaccaccatctagaacaagatatagaacatactcagcaccccagaaagatctcccttccactttcaacaacctctaagaggttactattttgacttttcccattgtaaattaattttcttttttcttgactttcaaataaacagaatcatactctcttgtgtctttgagtatccacagacacacagactcgccaatacatggagagtcattcatgtattgcatgtagcagtcatttttattgctttgtaatattaaatatataaatataccacaatgtacttgtccattccattgataaatgtttgggttgagtaaagctgtaatgaatattttgtacttgatatttgttgtaattatttcttccagatatatgtgtctgtatatggagcgaaagaaacaaaaagggggtgggtgatattgctaggtcctatggtaggcatttgtttaggcttacaagatactgttagtttccaaagatctttgtcaatttacactaccagcagcaatgtatgagagttccagtctctacgaggtcatcagcatcacaactgccattgtggtgggtggatggtagcatcacattcttatttgcatttcataatgactaatgatattgaacaacttttcatatgcataatgaatgtttaagtactctgttgtaatgtgtctgttcaacccttttgaccatttttaattggattttctgtttttatctcattgatttgtagaagtactctataagttctagacagaagtccagtcctttgttggatttgtctattacaaatattttctcccagtctttgacttttcattattataatagtgtcttctgataaatagaagataataaatttaataaaggtgaatttattcatcttttatttctttattaattctcttgaatgtctgtatttaagaaaaaaaatcaccaaaagatcatgaagatattgtcttataatttcatcaagaagttttattttttctgccttttccacttaggactatgatccataaataatttttgtatatggtataaagtagaaatcaagtttcattcctttccacaaatttatctaattgatccaggaacatgtattgagaagattatccatgccccaccaagttgcagtggcacttgttttagaaaatgagtgtgtatgtgtgggaatacttttggaccccaatcagttccagtggtatccattggaaagatttttctttgttccctataggagcaaagaaacattttctatctcatcactaggtttgtgattaagccctctataacaaaattcagattaatagaaaaaaaagcatacaaatttaatatgtgttttacatgacatggaattcttaataagaaaatgaaggtccctccaaaataggtaaatgtatattttttatgcttaggtttgatgaagagatggatagtcatgaagatgtatgattaaactaagggtatgatctaatgctaataatctcaccagggttggggcagggagagttaataaacaggacttatcaaggcctgtttgtttagattattccctaagtctctgagtcttcagagataaggatattcctttctcaggatatagggagaacacctcttccatgagggtcttatgaccagtttcaagggaaaaatcaacaggaaaatgagatggcttttctacttctgctgtttgctcacatgccaaggtgtcatatttgggagtggcatgtccatccctccaataccatgctgtcttaattaccatagctgtatagaaagtatttatattttgtactatatgctatccaactttgttcttcttctaaaagattgtcaggtccattctaggcattttgtattaccatgtaagttttagaatcagctcttgaattcctccctcctagaaaagattggggttttgactggcattgtattaaatctatagatagctttggggattaatcagcattttaacaatatcaagttttccagtctatgaacatggtatatttctctatttatgccttctttactttttcttagcaaagttttatagttatgaatgtagacaacttcacaactgttgtagatttatttctaggtattaatattctaaaaatattgtgaatgttgtttttattttctattagtttgttgctactatatggaaatacaattaatttttatacataacccttgtatccagcccttgttttttataatggttagtactacatagtctgtatatttacttttgtataatacagtatttgacactatagttgattttactacatttacactaatcccttgtaataacgccatttttgttttacaaattttctttataaagactttcaaatatcagaacaactattcttttggaatagaaagaaattcttaaaatcgttcttcaagtaaagctgtgaaatactatgctgatagcttcaatcaatcatattgtttaacaacatgatgttaatatttaggagctcaaattaccatttttagactcctgaaaaagaattttttctagtcaatacaaatcttgacattagaaaattacaaggaacaattattcttcatcagcatttactcaaattaattcaagttaatttgtccctttggaagtaaggatgacaatgaaaatcaagacttggagtgatttcttaataacataattatatgtaaagatgaagtaagagctataaacccaccctgtagaggtttcctaggtagggaaaaattaggtcctaacttttgttattcaccacacaagatgtccttaaggaaaactctaggccttcaaggtcagttaattattgtcagttaagcccatcctcattccctttcacccagatagaaaatgccaggtagactttaggagaataggtttggtgaggagcttcacagagtaaagcaaactttagaaattatatctggcttttcaatatgttccccaaaaggtaatatggaggacacagctcaggcctcgactcatcagtcttcatgtattatatcacgtagaatgaaagtacaaagcaaagatcactaaaatttctaatactcttcttcaatgtattgctgaaaggttgggataggtgagagcagggtaagagtaaaggtacataaacctttctctaccccagagtaaaaatggtggtttcttctattccagggcccaggctgaggcacgctcttctaatactatgttgaaaatttagcattcctcatattttacagattaatttttcaagaaccactgtctgatctgcccatagcttcatagttctgctatttaactttgcatggatttcctgagaagtaataatgctgaacacccctcctcccaccacagctctgcattacataaaaaagttatcccaaattgactgatgaaaaatcttcaatcatttctccctaattcttatttttataattaatttttttcatgattgccaaaggaggtaggtcaatctcccagtgcaccctacaatggtaatgcattgattaagggtaataacagtggaaacagccacaatactgtcattaaatttattaactgtttcttgtatgtcagacacttgtcaaggaagccacccactattcaatatctgaaacaaactaacaaggctgagtttgttgctggctatgcgagggagacatgtgcttgtaaaacagtctctctgagaatagcagagaactcattttactgggtttatggaggtgtgggctccggcatgggtagatttttagaattgggtgggactagggattggttgacctttagctgtgtcagattggcttactggattactggagccagactggctatctgctggcttccatgagctgggctactgaagtgagattgttgctcactgactgacgtttggaagccaaagacttaactcattggccaggcttcagaaatacagctcctaaagcttctaaagtaagttgtcatttgtcattaagaagggtttaaagctgtttctgatgattgcttgttaggatgtccaaaacacagtcttttcctgggaacacaagaatcttttactctgatgatactcaatgttaatattagttagtagtcagtttatagatgttacacaatttacttttcagaaaatcctttatgaatatgaattattagaatttccattttattcataagaaaactaaggcttatcttgcccaaagtcacatgactcataaatggaagaaacacgattcaaaacaattttaagtccaaaaaaatcaggacatacccaaagactgagtctacattcattcagtgaacagtataatacatgctgagtcatcaggaagccaggtgtagctgtaagcattgagaataccaacttacacaaaacacacaaaatctgtcttcctccaactgacgcctttgctatcttttgctgatatttgcattctaggccttttctcctgccagcttcaagatgtcacctggtaaataattctccctggattaggtcatttttgtataagtcctttgcccaatacttcaccaaaatcttaacttttttcctgtgaatggggctgtcccttactctttaccttacctctgaaaaatcagatttgcatttgacaactacacttagttcagatggctgaaggagattaaaatcataccttcaagttctaatttaatagttaacaattttattagagtaattttgtgcccatttttgaggcatccaaactaagtttatttttaccccatacttcaacgtaaggtgaaatttttctcaaaaaacaaagcagaagtagttgccttatattcaaatccatatgacttttttttatatattacgagtcacattctcagtttattttgagcaaacaagaacaatacattagcctgaagcaacctcagccactgctagtttagaatgctcagatgtcacccaaagaaatttgtttaaaaaacagggagggggcagacaaactttgcatagattgtagtcattattgctgagtgtgcagcttctcagctccaagtattgaatgttactgtaaataaagtctttaaggacaactttccaagtgttacactaaccgattatggtgaggaaataacagacacaaaatgaatttttaaaagaaactgcctgtatttctattaatggcttaattatcccatgatgatgtgctctcttctgtgttagaataatcacaaagtggctttttttagtgataacaaataactgaattaaatgtgtgtataaagaatttttataaaattatctcctgaatatctaagaagcacagcaattattctgaagtattattttctatgataaatggtttgtacatgtatatataataagttaattaagtacgaagtgtagattgtgattatttcacatttattgctaaaaatgtttactttcaagttaataaaatgaaacatttattttacaaaacagaagactgtcttattatcaaagtgaccttatacttgtacatattatgtatgttatttttcttataaattgaggaagttttgttaaattgctttactaggcacaaatctcatttagtacaaagcactcaaacatattttgtgtttatttggcttcagatgtagccaaggaggtcacagcatttctagaaaatttgtgttttattaagcatcctaggtacagaggtattcagcagaagaaagcttatggtagaaatatccccaaaattcccatgattatatctcaaagttgcctgcaaacaaacgattttcatggtatagaaagaggcccaatcctcttggtcttcatcccaggatccttttgggatgtccatctggtgatgagattgaggatcgcagtgtcaggagtgggtcgccctctaacctgcctttgcaccgcaagccagagtccaggaaggtactgtgtttttaaaaagaacagcggtaccatattattcagcagtatcttgagttttgtataagaagaaatagcaaccaaagtgaattcatatataaataaatagataaaagtcgcaatgtcactatttaaaataaaaaagcataacagaagagaagagatatctaagggcctaggaaatataatcttcttcagaaaatattttcttaatgagtcaggaaaaaaatagagaatttctacttagcattagtgagatcaaaggccattacatctatttaacagtaataggtcagaataaacagagaattcaaagaaccaagttaatcgaatcaataacaaataatgataagccttaaaaacctggcccaatactgccagagtgctacagaaaataaatatgaatacatatctataatgtggaagaaatggaaagagatgtctgttaatgtcacagatgacaatggactttgggaacagaatgtaaagaattgactttgaataacagtatttccaaaaaagaaaataacacaaaataatgagaactgatcatcaaaatgtaaaataaaataaaagggcctaagcaaataagttttgataatgtctaaaaaattgcatatatgaggctgaaaagttttcctaaagactacagcatgtaagaaagcatgatatcataattcttagtgtgaactgtaatatgagtaattcagtattttttcaagaagtggggaaagagagggtttcaaattactgtatcctatttactatagtcagatttactgtattcatgtttaatatataaactgatgaaagacttttacttgatgattagaacttagtcaatttttaggcaaatgttgtacaccacactgtcttattagtccatgtgtattgtccatccactggattccaggcctgctttaggtacagggacttctggcccaaacaaaaacagtaggacctgaagccatggagtttacagtgagaaaagacaacaagccaactgttggactttgacttaattatacttgtaatgagttctataaaagggaaatgatattgcaacaggaattactcaggtcacactggtgattagtgctgtgaatgcaattttattgcagtcaaacaacttcaagtttcacaatattacataggaactagaattatacttcatgaaggcagggattttgctctgattttttcactttcaatcccgagtgcagacaacatttcctggaatatagtaggcactcaaaaaataattgttcctcaactagtaaatgcataaaaggaattcttctactgactaattggttagctaaactcctacaagtagcctttgtgaacaaggagaaaaatagtaccttatttcatcatatataacaaaccatacattgtaagttgtcattgattatgacacattactattttatatgcaaaagataaatcaagtttggagaatctgataggacataccctcctccccagacaaggctgaaaatcgtagtgtaaaatgaacgataattaaagctacaacacagaaagtaaaattaaatttgcatgtctcaatcttgtcactgaatagaggcagggaaaacaaatgtcctttgaatttctgaaaatttgaaccataaagagtgctcacaccaatctgcaactccgaattcataccaccattatgttcccaaagaccagagacataaagaggtcccaggttggctaatggaagaaataaatggcaaatcctatctggaagaactcagcttcagtcgagactcagagaaactgtaatacagagctgctaatatgagtcttagaatccataaaatgcagtgtttagaacactcccatatgtcactggacaactggaaaagtcatctagattatgtttaaggagctaagaatggggattagttttccctttgtcagcaaagtccatctgtagccagtgacatgcattttacaacagtcagttgcaatctccaaattcaggagtgtcgaggttattcatagttccattttttttcctcaaaaaagaacagggtgatttaaaagtaaaatagagaaacctaagctgaatttctggcttaaacaagaaatctcttaggatggaatattttactgagatttggagtatatgttgcattagtcgaagccaaaagaacagaactatttccaaggaaggtaagatcatgtgctggtgtcctgaggtgggaaaagcatggcctgactgagttgttgaaagagagacattgtgcctttagaataaaaagcaagtgaaatagcactgcaagaagagtttgtggacacaggcatgccctagatcaggcaagaattctttacatttgtttaagaacagactctatccccagggcatgaattttaatgacaggaatgaaaaaagaggatttccattattttcaacatgtcctctcatctttccttataatctgggtaaatattgtctcctactttctgaaatgggtattgaactaaattttaactcacctttctttcctttaaccccagaatttcactccacaattagccaatacttctcaatttgattcaatagataggattccttcctttttccaatataagaaggttttctgtttcctaattataagtttttttcttgattcagcttccatttcttttaacacccataaattctttctgttttagttgctacgattttcaaatatttggtgtgtacttttacttccaagttctatcctgattcagtatcatctcagtttctgccagctttcatctgactttaaaactcttctgaaactacctgctcatcaaagatcaaaatgtgcttttccaccagatccagtggctttctctcatctctcatctcctgcttgctttaaccttgtatgttgttgacaatctcctgcgactttcttcaacaaattttgtccttcgttggctaaactattgcactttgttatctttctatttctcttcttccttttttttttttgagacaaaatttcacttttttgcccaagctggagtgcaatggcattgatgtcagctgactgcaacctccacctcccagattcaagtgattctcctgcctcagcctcccgagtagctgggattataggcttatgccaccatacctggctaattttttgtatttttagtagaaacggggtttcaccatgttagccaggctggtcttgaactcctgacctcaggtgatctgcccgcctcggcctcccaaagtgctgggattacaggcgtgagccactgtgtccggccttattctttttacatgaccttacttctttttcctctcttttccttgtcttagttcaacattctgcttctctatatccgaagaaagaggaaaaaaaaataccttgctatcttccccccaacagacatactttactaaaagatgttgtgctcttctattattctcttccatcatttaggacttcatttcagagatcctgaataaaacatatagataatttcatgatctggaatagaatctgcatttgtgactaacaagagaggttgtacaaattataatttctgactccttgttttctcactagaccatgtgctttttgaggatcaacactgtgcattattcataattgtatctacaaaacttggcaccttgttttccaccacagagtagacagcatatattttaatgtgcataactgtcctggtattatcttaaatctgttggatgtgtgttttgtgatagcataaatttgtttatgtgttaacaaaacacacacatactcttttctctctttctctctctctcaaacatacagagacagagagagagaaagagaacagttctcatcatcattaagccattttcgttggaaatattttcagaattaaccaaggaaaattaaccttcagattagtggacttcactccatgcaaatggtaaaagtgaaaatatgattcaaatttttaaaagcgggagctcagattgcttaatgtctcctttattctggtttacatagtagctccgtggctgtgcactgtaagtacaattatgattaatttccaagcataagcacttgttctcaaccgaaccattattttcttgcagaaaacaaagaaaaacttcctagagttctatttcttgtgtcaaaatcaaccttaactttagttcactaatcctttccaagggccccagctgatctatttaatttttcttttaaatgctatcttactagagtatttttttcatacttaggtcaaaaatcattgtaataaaaaatgttctacaaatattgaattacatgataaatttcccttggtgaatctctactgtcatccattttgaacgtcagaaattcctcgggcaatctggaaataaaatattctggtctgcaggctgaacttcccataaatgcaagctgtcactgctgtctcactctgctgatcagccaaccatgtcaagcaatgctgtcatttacttaagagaaacaagcaaacccttcaatcatgttgtttctgaaggaaagtagaaaagaaaaaccacaacattttctttttccttctttggcctaggatggtgaagcaaaattagcttagaattatagtaataataacaacgtttgctattttactgttgcaaatactttgtagtattaaccatttaatcctcacgacgttctagtagatatcataactttacctattttacagatgaagaaaatgagacattgagaggttatgcaattggcccaagtaaaacagctagtaaggggcagagcttgaattcaagcagtctaaatttaagagcacaggttcataatgctatgaggatcaatacaattctataatgggtgtattttaggtcatagatttttataatatttaattccatttaaaattaggaatttgaagaaaatgtctttatttcttttaatactaccagaaataaattatttcccattagcttcaaaatcctttgctcattttaaccatcctgataggtttcaggtttgtgatggttgttgttgtgtgtgtgcctttaagataatcatttttaatgccatatgtccaacttatgcttactaatttttatcatttgcactcacagccatcaaatctaaagccttttcctcctttaagctagtctcgttagaatataagagtgagcacttatttaggtcctactattcaccagacactattataagccctgtacctgatccttaagccccacgtccatcgtttgattaggcatttttattatcttcattttatagatgaggcttagaatgggtaagtaacttgtccaaatatacacagctcataaagggcagagttgacactacaaaacctaggtgtcttccgccctgaaagcacgtcttatttcctccctataaaaagacgtgacctcaagagtagtatcccaaatatatatgtcaaattttctacattataattttagagttatatttccttggaaacaaatttgattcccaaaacatattttggcaattctgttcttgaaaatattttattttacaaaaaataagataagttaaatgtatcatcatccacatttttctagcatagtgtagagaatttggtttcaaattttattagtgaaataatcgcaagtacctcctttcattaaagaagagaaaaagaaggatgaagaatgaaaggaaagaacgagtgtaaccattgctgattttactgtggatttgataaacattagtcaaaaacacatgtgataagccacatattattaaaaatgcaccatataattaatgctattgcattgtcattttgttacctagcatcaactggctcactgcccaaggtacacagaggccaataccatggcaccagctttcgagaaaagaaaagcattattgaaagtcacgtggcaaggagacaggaggaaatgctcaaatctgtctccctgagcgagggttgggtctgggtgatgccgaagttcaatctgattggatcctggacactgccatgcagtgtctgctccttaattcagcccctgctcctaagtctgagcactcaagttccccttgtggtagcacacttaggttcatctgggcatgctcagattatgtgaccttcaaccttggaatccatgtcaactgataaacaactcacagttttattacataaaagttgaaccggattggtctgatgtggctacagtttactacatggaaactgagtaaacgatatgaacatagtggtgctggtgagacaaatgagctctttagaatacagacaagattcctgagcaccccttttctagacacagccttccaatctcctaagcatcattctttacccatgtatgcaatgacacggtgttctgtttctcaaaggaacacacatattttactgctttattaagctgcttagttcagatgggccactaaagtgaccaattaactattaatttccttgtataagagatggctgaaggtcaatcctgagagcctaagcactccttaaagtttccctttaattctaacaaataacttgtctgtgaggcacacagatatttcgtcttttgaaaactagagcagacgtgctttgcacagtctactggggaaagaaaaatgtgcttgcttaacatgaattgcttgtaggagcagatatatctataatgcaatattattgagttaaatgagaaggacattattttttttttctttctgctctgttatgagcacagggtagggaatttggtttaaggtctcattatttggcaaaattgcaataacctcctttcattagtaagagaaaaaggaaaaggaggaggagaaagaggaggcaagattgtaaccattgttgatttcactgtggacttgttaaccattagtcaaaaatacatgctgataggccactgagctctgctagtactaataatagtctttctcttttctcttcttcaagcttcatgatactttcttgaaatacgcacacaaaacttactgtccggatacctagcacctctgagcctgagctgtctatgattagagtcagtaattatgctgtgagataatccatcatggtgggttttgtttgtggctcgcgataattaatgatgattccgcagaacagcagttacgcaatacagaagaaattcatcttctaaaggtcagcaaagagttgaagcatgaagtaaaataagcccatagctgctagctattttttaccaatcagtctttgtgagtttgttttttattttgaaaggcatagtgaaaatgttcataccttaataaggcattgtctgaaaactaaattttttgtttccttagaattagatagaattttttaaaagtttcttaggaaaagaactgattttgcttagaaaatacaccatcaggccatttggtatatgaagggaagggtgtgaactcacactagcacccaactctcacctcactcaaagacatgtaactctacaaaagtagtcagtaaaatttgcgggtgtggactagggtgtgaaaggaaagagtgtgagggaaaagtgactgattaatttctatggcaagtggggttaagggaagatatggctatgtataaacccactctctaaccagtcaacggtcggcacactcagaaatatctctgtgggggccgggcgccgtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggtgacagagcgagactccgtctcaaaaaaaaaaaaaaaaaaaagaaatatctttgtggggccgggtgcagtggctcatgcctgtaatcccagcactttgggaggccgagacgggtggatcacgaagtcaggagctcaagaccatcctggctaacatggtgaaacccagtctctactaaaaataccaaaaaattagccgggcgtggtggcggacgcctgtattcccagctactcgggaggctgaggcaggagaatggcgtgaatccgggaggcggagcttgtagtgagccgagatcgcaccactgcactccggcctgggcgacagagagagactccgtctcaaaaaaaaaaaaaaagaaagaaaaagaaaaaaaaaagaaatatctttgtgggtacaaggaaatagggccacatttcaaatttgggcacaaaagggggaaacggggacagggatgtcaaagccaggaatgaaatgtcttcccaagaatccccgatgatattaggaagcacatcgaattagccaccactgcttgtgggtgttgaatcaaaatgcattgaagtctaaaaagatgaggtggccccagctacaccttgaggttattttgttttatgtataaatgatttaaagttctgaaaatcatgttggtaatgacagacacactgatggtgacagtcatctcagctataaaaagcatcagagtaaacatgttttctagccctggttgcattaactaaagtagacacgttggtgacaagtcatttcaattctctctacttcagtttcttcaccttaaaaaaaatcatgcttaaaacttggtgataccatgaaatttaatatttaatgtaagaatgcatgaaaaagcataaactgcttattgagtgctactttgtgccagatcttattgtaagcagcatacatgtattcgatcatttaatcctatctcatccacacaagcatcctatgaggtagatactatgatttgtttaatttataaatgaatgaatgagtactaaggcataagtttcacagagagtgaagggtcaagcttttggggcagtatgatgccttcttttattcaataatcataaaagctttaatttttttcttttttaaaatttttatgtatgctctgttgaacatatttatagggtacatgtgatagtttggtagtcatacagtgtgtaatgatcaaatcaaggtgattgggatatccaccacctcaaatacttatcttttctttatgtttggaacatttcaaatcttttcttctagttattttgaagtatacagtaaattattgttaactgtagtcgtcctatggtgctactgaacactagatcttattccttctatttaattatatttttgtcccttctttaagcagcccctctttattcccccatcccctcaccccttctcagcctctggtaaccaccatttattctctacctccatgagagtgaaggatcaagcttttggggcactgtgatgtctttttgatgtgcctaattggataggccatagtctgcagttattcaatccagcactaatctaagatgttgctgtgaaggttttctatagataggattcaattctataagtgttgactttaagtaaggtaattatcctagataatctggctggcctgcttcaactagttgaaaggccttagtagcagagctgaggcttccctggagaagaaattctgcctgaggacagcagcttcaactcttccccaggagttccagcatgcccttcctgaagatcaacccccacaattgtataatccagtttcttacaacacatctcttactatgtatcttctactggttctgcttctctgatctgtaccctgactgatacagacaggagacctatgtacttcaccactgggctattctgccttccatcacttcagcctcaacctttccttcctccccttcaatgtattttaaaatgttcagaaatacgttgctttttagaaaagaggaaaacaaccatgattaattggctcagccaagatcacaaagttagtgtaaatctaaacaaagtcaggctgtcattttgaagaattataaaaacaactatgatggccagtattctacagcactggcacaactctctcacccttggcatcataggaagacccactagagcatactctagatttaatgctggacagtagcctcaattagatcacagaactgacgcctaagaagatacaggcatctgtttcatttccctcaaggggcaaaaggcatcaactttactgcccatacacgatcattagcatttcccttcacagctgtcacctgaggagcatatctcaaggaagcggaatgttgaactggagggaatactctgtcctcactgaggaagttcagattgcccttgcctttattttcaaatgctttgctccagctggctggcctttttagtactggctaacagtgagtgagttatagcagctgcttgtcattcatgtattaaaaactaagcatctctgtctttcaaagtcatgtgaaggaaacagacaggacccaaacttcctagtccattaatggccccacttatccataagcacacactttgctcaagtatgtcgtcagaactcctaattataatgctataaattatagcagagaattaaaggcagctatagaggaaggaagaaatatgaatattactaaaatgagaaggtaattaagttaccctcttccctctgagccagctctggttgtttaaaataagtcctaataacagtgttaaatgaactcaaagcacaaatgaatattaaactgacctactgcagaggttttatacatggcctgttaaggtcgttttcattaccagggagatttgagtcattcttaagaatgtgaaaggtgaatgtgatggttaattttatgacaactggattgggccacagtgcccaggtatttggtcagacattatcctggatgtttctgtggtggggttttttagatgaaattagcatttaaattactggactttgactaaagcagattaccctccataatgtggatgggcctcatacaatcagttgaaggcctcaataaaacaaaactgacctccagcccctcacctctccaccccctaccccacaagaagaaggaattctgccagcagagagcctttggactcaaactgcaactcacccctgggtctccagcctgctggtcaactccatcagattttggactcatcaagcctttatcattgcatgagccaattcattaaaataaagctgtcttatatatatgcacatacatactgtttgttctgtttctctggagaacactggctaacacggtgagtaaactgactacactggaaataacaagatgaacttcaggaatgcagaagataagaacccagttacattaatggaatagttactgcttaattttaattataatattctttgctagcattgtgagactttagtaaccaaacccaaaagaagcaattgttatagtatatgctaatatatattcaacaaataatggagtgctcatggccaaaaatgtctcttccaaagagcacatgccaatttcagggccactaaatgccaagctccagtaatgttccaggactttgggcacatatccagaaataggcaactagtcctagaaatccaggaaatcaacaactcatgagtctagctaatatttattgaacacccttatcacagggaggcaacaatggtgagtgggtgaatgacagcaaaacagtccctgatgtcatggagctcagaatctgagggaaaagtggatcatgcaaatgtataaatggagacaggtgctaataagaaggatgcctgtacttaagagaaacctgtagacaggctacacagagcatggtctacaagccagcagcattagcatcacttgggagctacttagaacacaggatctcaggcccctttctagacctgcactttaataagatccccagataattggtgttcacattaaatttgagaagcagctggcttaagggataaagaaaactgctttactgtggatagtatatttcagttgagatctgaaaagaagagggatcatttctataccctctgcatgtttactgctgggcttcacagtgactatgatcatttctataaggcagtcattattgctaattgcgaaatatttccaattctcttcccagacatcttgaaggactgcccttccctaaccccatgaagctggatctgacctagtgactagttctggctaggtgaatatgatcagaatggacctgtgtcacttctggtgggatttttaagactcattatagtttgtctgctttctcctttctgccacgataatcggcagtgtatagttagtaacagctcagtcaacgggaaacctggagcagaaacgtcaattcacctacaattaacatgggccttgaaagagcagtaaactgcatcatactaagcctctgagatagggtggtgatttgctcctgcctaattggtatactctatcatcaatggattcattcaattggtacccagtgagtgcttatgaggtgtccagctaatccaggctctggggattctgtgatgaaattagccagacaagaccctgctgaatcttctctttttctagagaaagctgggcaaataagcaaccaaaaaaataatttcagatggtggtaaaaagtaagaagaaaatgaaacagactggagagattagacaggggatgataaggctctttcaaaggaggtggtcaggtcaggaacagcctcccttctccaaggagctgatatgtgacctggtacctggataaggagaaatctcagccatttgaacatctggagaaagagcctgctgggcaggggagaagaagtacaatggcccggagacaagaaaaagcttggcatgagaaagtaatggaagcacaatccttgtgaagcccagcagtaaacatgtggagggtggagaatggtttaagatggggctggagaggcagctggaaatctgatcccagagatttcaggtctgttcagaggtttgtgttctattctaggtgcaatgggaatatgtgatctgaactataatagtatcactctgggtactatattcagcataagcttgtaacaagaagagagcgagcacagtaggagaactaaaagaaggctaatctaatgggggttacttaaaagggcagagaaatgcaatcggactaccagcctagaaggatagataactggaaatactaatattaagtgtatagcattaatgactaatgtcacccttctgttcaccagatacttgatttcctctcctttccccatgtactgtatattcaacccctccctaagcgggacaaccccaaggtcccactagtcggaggatcagctctgagttcaagatctcctggtgacatatcctagtccctgtatcagagaataatgtggtggtttctgtatcaggtttggatgtgatttcacttcatccagaaatctatgaactaaaaaggtgacttggctaggcgtagtggctcacgcctataatcccagcactttgggaggctgaggcgggtggctcacttagggtcaggagttcaggaccagcctggccaacagggcgaaaccccatctctactaaaaatataaaaaattagccaggcataatggcacacgcctgtagtcccagctactcgggaggctgaggcatgagaatcgcttgaacctgggaggcagaggctgcagtgagccaagatcatgtcactgcactccagcctgggtgacaaagtgagactctgtctcaaaaaaaaaaaaaagaaagaaagatgacttacatgcccaactgccacctgaacacacatccacacccaatatgcaactgcagaataaatacataataattctaaagagattcacattcagaaaagggaagaatatcggctacatggcagacatttgatagcaattctggaatctaggcagtgattgtgaaggtttactaccttaggcacagagaatgttcccgtattaaattgcagttcttatgtcttggaagggttctcttgtccagttttccaaaattcttgactccatcctctaagatgttcttcctttgagtttcttctgtccttcaatctggaatgtatattaaaggatcatgcacttcaacatctactcattcataattctttattttaaaatttcaaacagcctctgtccctttaagtttcagcttgtgattcatttgacagtacagttctctgaagaccttacttaatttcttcaatacctacatttcttttccaaacatacttctatttgctacttttgctttataacacccaaatctcttgtctcttttcctctggacataactaaggtatgttggactatccagtttaggtgagagagccattttgtccaattaaaaagatttaggcaccacgcctttactaggtcatggatctgagtcaaagattttaacaataggtgtgacagtcatacctagaattcatacttgctgcaagagtaattctcaaagaccttctcagcttcatcttttaaaagggtaagattccttactgcaaatcctccaaactagactctctttcttcctacatacaaattggccggttcttttgtaagctcgttattgtcttattagcaccctgacaaatgcagtcaacaataaccaaaatcaacttcaaatgcactttaaaaactaagcacttccctagaacagggtttggcaatcctgtagtccaaatccagacaacaacctgattgtgtaaaaggggaactaaagattgtacaaacaagcaatgaagaatgtgcaacagagactcatacagtttgaaaagcctaaaatccttactgtctttctctttacagaaaatgtttgccacgtacttacctagaagtacaaatatatacctcccaggttaacctaccaccaactaagctctcatcccagaataacacgagctaacctccttcttacttccaaacttcccttgccacctactaatcattaagccaaagccacacattttaggttgttttaaggcaacacctccatttcttggtaccaacagctgtatccatcggattaggctagggcatgctgcgggcctctgcttatcaatctctctagaaccacactgatggatatttcatgccattgcaagcttccatgagcatcataacaaggaaaaaatgaacttagcaaattgtgcactgcctcaaatcttctgcctgaaaatgacacattttatttgccaaattaaggcacacagccatggttaacttcaaggtatagtggtttacttaaaggtagccatggtttactttcccctggaagaggaagtaaaaaagaattgatgatggttgctaatagctaccacacctgcagtcccattccacaaaaatagcctccattaggggatggtaaaaatattttcactttgtttcatgcatatgcataaatattatcttcctctaacattacctttcacataataatcattatatgcattcatacttatagtaaagggcagggactatgactattttgcctatcataagatagagcacaaggaatggaatgaactcaactatttattatattaatgaataaataaactaatgtcattatttctatgttacttgtttctatgttcattctactaatgatttttgttatttttttacaaacatttgaaccttttattcctcatcaccataaagaatgaaaattaaatagtgcctgtaccctttcacctcctagactatgctaagtatttaaacagaaaacttttttacctctgtccccttcttacatattctgcttttctttatttttattttgctgatctggaattttttatctagatttttactaactttatttcacattatgattcttcaatttttagaaatcattcttaatattattttaaatttgcatgtacaaaattaaccataattagatttaactataagttctatgccctcattgtctatcaatgtttcctccaattttcttgagctctttattttgatacattcattgtttgactataatacttcaaaaaaaaatttttcagaactagtacatggtgaatggtgtttctgaatctttgcgtgtccaaatataactttcctttgcattcacatgaatgatggtttgtttggatcttgaaatggagcatgaaagttatcagaatcaaaatggagtcaattgtgttaaaaactggggaagataaatacagctaggaaaggccatgaagggaagcttctcatgcacaaatgactgagaacaaaaactatcacaaaagattgcaaaacccaaaatctcacacaaagactgcacaaccttacatacacacacaaaaaaaattctgtgaggacgtctgcccagcaactgcttgttcaaccttggactaattccacccttgttattgacccttgtagtcaaggattattgtctcaaaacaatgatgtaattctcctcatttttctttaaaaaacttttgtcttcctttaccaccctgaatgagaacctagtttactatggcacacatattcccattgcaatgcctatttccaaataaatatcatttccatttaaagcatctccctctctgtttgttatttaggatgatgggagtcacagtccacttgcactccaaagtttgagaagcactagtctacgctgtatttgcagctcttgtggactccagcaagaattgtgtaactattgccttctagtgaaagccactgtatgccaggaggcagattctgaggagggtgaatcatcgtggatatagcagagaaaagcaggcaactggtggacaatctagtgccacctcacttcatttccaaagctattcccaccaagtttagcctacgagaatgataagtccacttgctgcgtatgtggagttcaggctgtgtcctcaaatcctctactcactcctttctaggctttccctatcatgtccacatcttccttcctctgccacttcatgtggggtagtggagcgactcctagcggaatctgtgttccattagcattacagctactcactgaaactattgcactctcctcccttctactggctccatcacctgtgttaggagctccctgtaccaagtcttccactttattgagtaaatagttagagccaaagggaacactgtgataaagcctgtgtcagctgccatgttgattttctactgctactgtcataatcacaaagttagcagttaaagcaacacccattttgcaggccagttctctgctctgggtttcacaaagtgatggacggggtgtgttcttttccagagcttctggggatgaattcgcttccaggctcattcatgttgttggcagaattgaattccatgagattataggactcaggtccggtgtccctgccagcaatcagcccagggttggttgttctcaggttttagaggctgcccacattctttttggggtggcatcttcctcctgcttcaaagccagcaaagacccttcacagtagttcctcgattcacgttagattaaatcagcagggagcaggaattttgtgggacatcttttgaattctgccttgtgcagctgcactatgcaaatgattaggaaaaactgcaagttcttattttgaagtaattttccaagtgcctgcagtacatccttactctcactcctgcttatcactgggaggattttatatggaaagcacttccctaactttttaggaactccctgttttgcctgtgatgaaccactcagcattttcccccgcattaaattacaatgacttcatttgaaacagaaatgcctcaaattttgggatctacttatgatagccttccctcttgaccaggactcaaagtctattttgccctaatgtgtctttggtcaataaaatggaatttggagagtttgagaaggtatatttgtaatttcaatccctgtctagaaagcatgaaaaaagatattagaaaaaaatgtgttgctcttgagtattattgccattgatgagttccacagtgctagtagactacattaggaatttgaatgaagcagaattgaatgaattctatttttaaaaaaatgaattgtacattacagctcacaagtatccaagagctaaatttgaaatgtcaaaggttatgtaaatcttatatgtttagctaaccctgtaatgagaaagactcccaacactgaagtctcaaatcgtttttgagaacactgaggagagaagccacataatttgagagtgtcataaccgggagtcctagaaagaggaagatcaaacagccgatgtgaatttaggccatgaagaggtttaatttaaaagctgagagcaaaatcacagtcctttcataattattataaggagatattgggtaccctcactctggcagacctgtggtgcctaatgaaaagagagcatttctctcctgcttggcttattttatccctaatcagcagcggtacttcaaattagcttcacaatctattggcctctctcagccataaaagcctcttttctcttttgatattagcatagctccccattgaaagtaacagaaaaagagctcctacttgaaggttatatccttccttgtggatggcccacttcaaagggttcatcacatggtccaaagagaagtaaaaataagatgaggggagtgcagcagctgtgtttctaagacaagaggttctgagctgaagaacaccacatcgattaaggtcagggcagctgggaaggttgcagttcagccaaaagagggctgaagtactgaacttgaaaactctagaacctgggaaatgtaagcattaaactcagagacattttatggaaaaaaaaaagttttattttatagattcagttctgtaatatagatattggaacattaaaatgatctgaggtattgacttcaaaatccatcatttggggtgttggattatctgttatttacttaactccattagcacccagctatggataaattgtgtgtaatagttgtgttttatgagatcaagattttaaaatagtgaccactgatttgtgtcctctatatcatttaacctctgttgtctcataaatgtggctgagggcaatgagcttatttaaggctaacctgcatattaatacttttatccactgagatagtactctcccccacttaactaagacgtttgagaattgccaaaaataatctacctcaaaatatattcacatatgcatcgtctaagtcaaggaacagagggctcactagaatggattggccctccaatgaccccaacagtagatgttgatgcttaggaaggatagatataatagttgaagaaaaaatttgccagttgaaacttttgtttgattttgccactttgtcagtcattgctttttgttatggccaagttaagttgttacggaattagagaattttggaatttttttgtaagtgttcttttaataaatgtctactcaagccatctgcccatttttatttttattttttgttttttaacttttattttaagttcatgggtacattgcaggtttattatataggtaaacttgtgccatggggggttgatatacagattatttcatcactcaggtatgaagcctagaacccattagttatttttccttctcgttttcctcctcccacactgtaccctccaataagacccagtgtttgttgttctcctttatgtgaccatgtgttctcatcatttagctccctctaataagtgagagcatgtggtatttggttttctgtttctgtattagttttcttctaaggataatggcctccagctctatccatgtccctccaaaaaacatgttcttcttttgtattgctgcgtagcattccatggtgtatatatactacattttctttacgcagtttatcattgatgggcatttaggttgattccatgccttttctactgtgcatagtgctgaaatgaacatatgcgttcatgtatctttgtaatagaccatttatattccagtaatgggattgctgggtcaaatgccatttctcatattgggtctttaaggaattgccacactgtcttctacaataactgaactatttagactgccaccaacagtatataagcatttgcttttctctgcagcctcaccagcatctctttttttttactttttaatagtagcctttctgtttggtgtgagatggtatctaattttggttttgttttgcatttctctaatgatcagtaatattgaatttttttcatatgcatgttggttgcatgtacatcttttgaaaagtgtctgttcatgttctttgtccactctttttatggtgttgtttgtttttttcctgtaaatttgtttaagttccttatagaagctggatattagacatttgtcagatgcatagttttgcaaaaattttctgccattccataggttgtctgttcactttgctgatagtttcttttgttgtgcaaaagcactttagtttaactagatcccatttgtcaatttttgcttttgttgcaattgcttttggcatcttcattataaaatttttgcccatttctatgcctagaatggtattgcctaagtcattttccagggtttttatagttttgggttttacttttaagttttaatccatcttgagttaatttttgtatctggtgtaaggaaggggtctagtttcaatcttctatatatggctacccagttatcccagcaccatttattgaatagggtatcctttccttattgcttgtttttgtcaggtttgttgaagatcatacaaatttaggtgtgtggcctcatttctgggttatctattctgttccattggtctatgtgtctgtttttgtaccaataccatgtggttttggttactgcaaccctgtagtatggtttgaagtcaggtagcgtgatgcctccagctttgttctttttgattagaattgccttagctattcaggctcttttttggttccatatgaatttcaaaatagttttttctagttctgtgaaaaatgtcagtggtgatttaatagaaataatattgaatctataaattgctttgggcagaatggccatttttatgatattgattctttctatccatgagcatggaatgtttttccatttgtttgtgttatctccgatttctttgagtactgtttggtagttctccttgtagagatgtttcacctccctagttagctgtattcctaggtattttgttttgtgtgtgtgtttgtgtggcaactgtgaatgggattgcattcatgatttggctcttggcttgaccgtttttggcatataggaatgccaataatttttgcatattgattttgtatcctgagactttgctgaagttgtttatcagcttaaggagctttttggctgagactacggggttttctagatacaagattatatcatctgcaaacagggataatttgacttcctctcttcctatttgaatgcacttatttctttctcctgattgcccaggccaggacttccaatactatgttgagtaggagtgatgagagtgggcatcctcatcttgtgctggttttcaaggagaatacttcagattttgcccattcagtataatgttggctgtgggtgtgccatatatggctcttattgttttgaaatatgttcctttaacacctaggggtttttgtttgtttggttttttgttttcttgtttgtttctttgcctgttttttggtttgtttgttttagacagagtctcactctgttgcccaggctggagtgcagtggtgcaatctcagctcactgcaacctccgcatcccaggttcaagtaattctcatgcatcagtctcctgagtagctaggaataaagacatgcaccaccaggcctggctgatttttgtctttttagtagacatagggtttcaccatgttggccaggctgagctcaaactctccacctcaggtgatccacccaccttagcctcccaaagtgctgggattacaggagtgagccagcatgcctgaccaatacctagtttattgacttttaaacatgaagagtgtttaattttatcaaaagaatttctccttcgattgagataatcatgtggtttttgttttagttctgtttatgtgatgaaacacatttattgatttgcatgtgctgaaccaacgttgcatccaggaataaagcctacttaatcatggtacctacactttttgatagataacctgctggattcagtttgccagtattttgttgaggatttttgcattgatgttcatcaaaaatattggcctgaatttttcattctttgttgttgtatcatggccaagttttgctatcagcatgatgctggcctcatagaatgagttaagaggcgttcctcctcctcaattttttggaatggtttcagtagaaatggtatcagctcttctttgtacatctggtggcattcagctgtgaatccgtctggtcctgggctttttgtttttttttgcattggtaggttgtttattactgactcaattttagaacttattattggtctgtccagggattcagtttcttcctggttcagccttgggagggtgtatgtgtccaggtatttattcatttcttctagattttctagtttgtgtgcgtagaggtgttaataatattctctgatggttgtttgtctttctgtggggtcattggtaatatccgcctcatcatttctaattgtgtttatttgaatcttctctattttcttctttattatctagataacagtctatttttttattaattttttcaaaaaatgagcttctggattaattgatcttttgaatggttttttgtgccccaatttccttcagttcagctctgattttggttatttcttctcttgcattgggatttgtttgctcttgattctctagttcttttagttgtgaagttatgttgttaactatagatctgtctaactttttgatgtgggtatttagtgctttaaattcccctgttaacactgccttagctgtgtcccaaagattctggtatgttgcatcttagttctcatttgtttcaaagtacttcttgtaggttattcaattttcatgtaatgtgatggttttgagtgaatttcttagtctcgatttctaatttgattgtgctgtggtccaagagattgtttgttatgatttcggttcttttgcatttgctgagaatgttttacttctgattatgtgatcgattttagagcatgtaccatgtggcaattagaagaatgtatattctgttttggggggatggagagttctgtagatatctatcatgtccatttgttccagtgctgagttcaggtcctaaacatatttgttagctttctgtcttgatgatctgtccaatattgtcagtgggttgttaaagtctcccactattattgtgtgggagtctaagtctttttgaaggtctctgagaacttgctttataactctgggtgctcctctattggatgcatatatatttatgatagttagatcttcttgttgaattgaaccctttattgttatgtaatgtccttctttgtcttctttgactgttttggtttaaagtctgttttgtcagaaactattattgaaacccatgttttttctgttttccatttgcttgttggatttttctccctccctttattttgagcttatgtgtgtcattacatgtgaggtgggtctcttgaagacagcataccaatgggtcttggttctttagcttgccactcaatgtcttttaattgggggcatttagcccatttacattcaaggttagtattgatatgtgtggatttgatcctgtcatcatgatagctggttattttgcagtcttgtttatgtggttgctttatagtatcactggtctgagtacttcagtgtgtttttgtagtggctgctaacagtcttttcttcccatatttagtgcttccttcagtagctcctgtaaggtaggtcccgtggtgacaatttccctcatcatttgcttgtgtaaaaaggatctatttctcctttgcttatgaagcttagtttgaccagacatgaaattctgggttggaatttctttttcttaagaatgtaaaatattggccctccatctcttctgtattgtaggatttcagctgagagttccaccattaaactcatgagctttcctttgtaggtgacctgacttttctctctagcttcctttatcactttttctttcattttgaccatggaaaatctgatgattatgtgtcttgagggtgattttcttttgacatatcttactggggttctctgcatttcttgaatttgaatattggcctgtcttgctaggttgaggaacttaccatgaatgctattctaaaatatgttttccaagttggttccattctccccatccttttcagggacaccaacaagccatagatttgatctctttccataatcctatgtttcttggaggttttgttcattccttttccttttttcctctctctgttctagtctgactgactttcttatttcagacagccagtcttgaagctctgaaattctttcctctgcttagtctattctgctattaacactcctgattgaattataaaattgatgtagtatgtttttcagctctatcatgtcagtttgcctgcttttctgtactgtctatcttgtctgtcatctcctgcattgttttatcatgacttttaacttccttgcactgggtttcaacatactcctatagcttaatgatcttcattcctatctatattctgaattctatttctatcatttcagccatctcagccaattcaaaacccttgctggagacatgatgcagtcatttggaggaaaagcagaactctggcttttgagttttcagcattcttgcactgattccttatcatctgtgtgggcttatctaccttcaatctttgaagttgctgatctttagttttttttttcttttgtcctatgatgatgatcttgagggtttgattgtagtataagatgaattcagccaactggcttcatttctgggagatttggggagaccagttctcaggtcccaactcctagactgcatgctctaactctggggaacttgtattgggccccaactttgttcactggctccccaaggtttggaatccactgcgctgtgaaggccaaggtgcagcaactgcagcagcatgctagtggatgctggggtacctgcctccctgtggcagctcaccacagtggcagaggcaatgcagctgctgggggcaggggactcctgttggggaatgtgtgcatggtggcactggaggtggtgttggctcaggggcagggtactggctggcacaggtctgggtgccttctccatgccccacaagcaagaatgattgccctggaggaatttaatagaccatgcaattaaaacctcatcatttcacaaactgaaaaataaaaatcagaactaaattccaaggagattaaatgcatggcccaaagtcacatggctaaaaaatggcaaaggccccaattactatatttttattcaacaaatacttactggcttttcactatatacaagacaccgggctcagtattcaacagagaaaaatgtgaataaggaatcactatgccctaaagaaagctttctccaactttttcatgtctcagtatttggtgttttgtatcatttctgaatccttgaggcatgtacatctagaaaatagactgagcatcctcaaatcctcaaattggattccttaataagagttaaagtttaaaatctaaagttagcaaaaagaaagagaaaaaatgtggaagaattttagatgttgcctgaagtcatggttttaaataaaaaagtatatatgatagtatgtgacccagaacaaaaaagtataatttgcttaacccaagaggctcatttttggctaaaaatatgtcatggtctgatgcttttaaattaaacttttattacttagccatgtaaagtatttgatttttgaaaagactttataatcaagtaattaacaaaggaatacaaggacatttataaaatgtgaagtgaagaaagactacaagggacacggtcaactttaatttctttccaattggaagacttttctttaagtcttgtaaattacatgcttctctctttgacttctctctggtacttccaggagaaaaattcgtgaagcaacacaaaatggtcatggcaataaatatttcttgttctaaggatgtgaaaatagacgtctattctactgcactctctcatttacagagccagattgggtgctactctcatgggtttgcattgctatctcccaggtaattcagtcctcctgtattttgggcttgggtgcattgagcaagcaatttcctattggttccgctttcttatacaaaacacaaagcatgcccttaaaagtaggggttagacatatattactccaacaggcactattctccacatgactcataaaactgatgggcattcctcagactcaaacagacaggttgcggtggctgcctacttcatttcacacatctcatttttataacttcagtcactttccgatttctcctgagtgatttctatttgagcaactgcttaagttcagtcataaagatctgctagcttcagaaataggctctcaaatgtgaccttcatttaaatgtgtaaggcaatttcagggctctctaacatttctgagtttaaggtactattgacaatgccaaatacaatgttcttgctttttatagccagtagtattcttcttcttctacttcagagttcaactaaagacctgaaatgctagatagaatctgtgcaagctttggttaggctcacaggatcaacttactactgtccttgtgttaaacacccggtctagctaatcaggtgtcctactactgaaaatgctataaccacctaatatttatcagaaataactaaaaaaaaataaacctccaagtttactgctctaagaaactgatctatcaagaaaatgtgctgtattcatgtttaacaatttattcaatatgtgttcatgattctacatgttaacaattattttgggttaagtgtacaatattttaataagtggaaatgtgtgattgtgttgacctctgacccaattcggcactgcttgatttgtaatagcacttactactctccctgctacttctctcgaagctgtctccaccttggagaaagataaaaggggagagggggagaaatgcctttagcaattcaattcaacagctattcagtgtgcttccaccatgttccaaatatggagtttaatgatagaatgcagcaaacagcagacgatggttctagtcttaaggagtttgtggtccaggaatggtcacagtcatgcacataaacaattggtccaggaagagtagaataaagggtaaaatagaggtagatctaaagaattgtggatacactggccagccacggtggccaacacctgtaatcccagcactttgggaggccgaggcaggagcatcctttgagtccaggagttggagatcagcctagatagcagagtgagacccccatctctacaaaaaattaaaaaaaaaagaattgttgaaaaacagaagaaggaggaaacaattctcaccagcagtgcagggagattttctcaaacagaggaaattaatagggttttgaaggcaaaaaaaaaaaattccgaagcagagaatgaaaattctcactgatgtaatagctggagcaaatgtgttgagaaggaaaagttcaaattgcatttaaggagcttctatacaaaagcgttggtggaaaagagtcatgcatggtcagttgcagctttatgttatgttttgtctctaattcatgtgcgtgtctttgtttagtgcaaccaagcccccacatagacatttttaatctcataatgccaggtcctcaggcaggctttcctaaaatggcctgttttcaactgaggcctacagggcgatttggcactggctgtgactggactgttttccagggtagtccaccctctagggttagaagatctcaaatagcctaagctgtgtgaaggcagaggaacatttcttttctgagaaaaataaattctcttttgcccagtttttagtcttttcttttaaagaatctccgttctttactaattactattttttttttttgagacagagtttcactcttgttgtacaggctggagtgcaatggcacgatctcggctcaccgcaacctctgcctccctggttcaagcaattctcttgcctcagcctcccaggtagctgggattacaggcatgcgccaccatgcccagctaattttgtatttttagtagagacagggtttctccatgttggtcaagctggtctcgagctcccaacctcaggtgatccacctgcctcagcctagtaattactatttttattttaccatcttcttttccatacattgaaagcagccattagcataaataattgtgctaaacttttcttgagctgcttcagtttctttgtggacatagaaaaagctctcctctctccccatctcttaatccatgatgtcacttctcagcttacatatcaactgagttaatttctgaggagtgtctagctctagcgatgttgaaaatatattctcccaccaatgttgaaaatatattctcccacccgtgatttcatggtctaaagtagaggtttctcagtaaaaggtcagatagtatacattgtagcctttttggagaaaacatactctggtacaactactcaatttgtccatagcaacgtgaacacagccatgaacaatataaaatgaatgggcatggctgtgttccaattaaactccagctatggacactgaaatttgaattccattgaattttctcatgtcataaaatgttatttatgtttttaaaaatcatttaaaaaatgtaaaggctggctgggcacagtggctcacacctgtaatcccagcagttcgggaggccaaggtgggcagatcgcctgaggccaggagttcaaaaccagcctggccaacatggtgaaaccccatctctactaaaaatacaaaattggcctggtgtggtggcaggcgcctgtaatcgcagccactcgggaggctgatgcaggagactcacttgaaccctggaggcggaggttgtagtgagctgagattgccccattgcactccagcctgggcaataagagagaaactccatctcaaaaaaaaaaaaaaagtaaaagccatgctaaatttgtgggtcatagggacaggacttgtttgccaggctacagcttgccaatttctggtctaaaacattgacagagtgggcctattgcttctgaagttgcttgcttctacagtgttatatttttctctatacactatctctgcaaatgatattgttctctgtcttagatgctgacttgtttgctgctgttaatcactccacctctattactcaacctgttattattatcatctttattatctattgtgcatagttcatatacattgcttatttaatcttgacagctgtccaaatggtataactaagtaaaacaacacagagtgttaaagaatttgcccaagattatacaattcttaagtggcagttacaaaatttaaacctatttcagcattgtaccagttctcttgaaaacacatattgtctccgtgtcttctcccaataattatattcttttccaaggtttcccttcatatatagctacctatgattacttttttttttcattttcaatgcttaccaccatctttgcagctggattctagtaattcttacctaattctattgtcactttgtaactgagtattggctttctaataatcacatatgagatgaaagaattaagcactttaaatttattaatttaaatcttaaaatggacactaataaaagtgaattagtaacaataatagtggcaaatatttttgagccagaatcaggactgagtttttccatgttttaagcttcaatatttctatgaaatgaatagtgttattatttacattgtgtagtttttttaaaaaactaggtcatagggaagctgccagtctacctaaggttgcagagctaataagaagtggcagagctagaatttgaactcaggcaatctcactcaaaagcatatagtttaactattgaactaagaaggaataataataatggaaaaaaggaaggaaggaatgaagggccgaaggaaggaaagaaggcatacaggaaggaaggaggggggaaagaatctgaaagctgtgatgaaggggaaaattcattggaaattaagagatctaaattatagatgagactctgtttttgagcagctgtatgaatttaggcaagtcacttcagcttctttcatcccctccttttttgccatttgtcatctgtaaactgaagccttgtagctaggtgatcatgatatcctctagttctatgatcctattttaaaaaagccgtcttcttttcttctcccccttcctgacagaagagcacttctgagacctcaaactttattatataagccctctttgattatttaaaatctgtaccctttaagtgaaatcaaagactgtcaaaacagatattttatgtctagcatggattgaagtgcatgattccctgcagaatgcaagggttacaaaacagtaatcagttgagacaaggattctttgagatgagtaagcatattacacagcagaattataatcagcagtggctaggctcttttacaacagagtcaaaaacagaatgaaagaggccctgagcatgcaggcacagaaaaggattccatgttactgacaggaactttagccttgctcccacctcagcagcatcttccttctgattgaagggacccttaggtgcccttgcctctggttctgaatggaggctttcccactgccaatacaggttatgaagggtaatggcaggtaatcaagcagaatctatcaattgttaatgcctgataaataataaaacctccccaggtttgttcctttttctgcatgaagagtaaacagcatccctgatgttctggaattctttgtagtattcttactcttattcttttcctttcttttgaaaatcacattttattgatttaatagattaaaaaaaactcccatgacgtacacttcatatcactttatacaagatgaattaaaaacagtgaagaacatacaaaaccaatatcttaagtccaatgacgtttagtgtgtataatctatatactgagatacacatatcaaagatatatctatgagataagttctgaataatgacttataattagaaatattaaaatgaatatcttatattggtataatactttatagctcataaattactttcatgtgtttcttagcaaaaaattgtttgtattctaattaaattgtaacttaatatgattcctttataaaattatataaattagttacataattatgattcctgcatcataacagagaagagtgaaattcagagcatgaagtcatggttgtgaggaaatataactattatgtttcaggacaagaacctgaaggtaaagatttgtatgacagtcccagtgctctttcccttcagccacagctgcctcagaggaagaataactccagagcaccagaccttctgagtcctcctgttcctatcaaattaactaccctccatttacctcagagtaactctagaccaggcaattcagggccataggataggccttccatcagacttcaagttatttcctaattagaacctccccctctgtttatgtcctgaagaggaaaggtaggacaaatcatttgatttcacaaaattaaaactctcagaacaaacaaaataaagtttgtgtgaccacggggaaataaaagacagatacagggaggagacacagtaatatgacagaatttggtgcacagaaatatagaacacaaaaccaaatagataatgatctggacagataaaaacatgaacagatagtgcatagagttctgcctaaagatttgttcttcgttattatttaagataattaaaaaaaagaattcttcttttagatcattttaacacagtttacaaaaatggtaacattttattgtgtcttaatatgatggagttgtatctcattaaatatttttaatgtggcaaatccttaatagaaagtagtatcatgtacaataagccaatggattttaatatatataacatcaagataacactataagaaagagtgaaatgaaggataagttcaaaaatagtaatgtgtctgtaataaagactttgtaaacaaatttgggataggtttttagataaaatgacaggatacccactagtatgtgaatttcagataaaaaacaaataggttttagtataactatgtcccaaacattgtgcttaaatatttgccaatatttgctaaatttggccatcctaactgagctggtatctctaggaaatgccagtagaagctagctttgccagctcaatgagtgagctgggtagtactttctccccactcaaaaaggctaatccatcattgagagatttatgattatgacatttaagacaattttaacctggtcagttccaggaagtattgcaaacagatttttatttggcctgaatgtgctccccatgagctaaggggaaaaaaattagaaaaaaaaatctgagccactcttgtgcactaaatactgtacaaagaggtttacgtttattatattgtctctgttgattatattgtctcaatctttataacacaactttaggaaaggtatgcctaagccattctactgatgaggaaaatgaggttcaaagagaacatttattcttcaaagtgcaaaacagggacacgaacctgtttcctgcgttcatttctcccatcagttcattttctgtaagcaatttgggagtttgttgagacgttttggccaaagtcagagactaatccacagcaaaacaccctcagagccaaagaaaccacaactctgagtaacaggctgtggtatctgtcatgtcatctaaaagatactgaaatttcttggatcattgtagtcagtggtcatagaacacagaagcaggcaaagcctcagatggccaaagctggaggagatatctattcacttctatgcatgtgcttcccttgataatgagaaatggtttatcatgtcattttaagtcaacattaaaatactttggtcactggaaatatatgcatccaatataactattttacttttttaaaccagtgtgccacagtggttacaataattctttcaagtcttttaattaaaaactttttaccctaacccttgaaaaaggacttgtatttatttttgccagaaatccatgaaaaagtaatctcatagatttactagaaatgatacagatcttattatttgtcaactggccgtaactacaccgtacataacaacttacagctaacgatattgcagtcagaaatgtaaaggaagaattgtcacagttatattcctgtagaatctagttaacttctagctagggacacataaattgaacagaatgaagcagttagtgagatactattcacaactaagcagacggagttatttttcccaaaataatatcaattaactgagagaattattctttattttaaaaacaaataggtggaagctggaagcagggattagctttttcgtgttagcagtttcaactgcaggcattacatagagcccattcctatgacttagaaaggaccacacattcttaaaaattacagattcactcatcttccagaaaaaaagtcatgcaacccagctccagctttgcgaattatctaaccatagatgcatctataaaggatagatcgctgtccattccttattaaatttactagaaatgcagacacatctatatctctctagttattagctatctcaatggcttaacaccatagtaaagaaaatcagaatctttaaaattaagaagtttgtatgtagcagataacagttgctcaccttcttataaaaatcattagagatgatggcgtacacagctttttatttctagattccagacttccatctacttcattcattcatccattcattcattcatgcatacatctagttatatgttcatttaggcaattaacatttatttggcaactaccctatatgcaggcctaactttagatgctagagaatacaagcaattataaacaagtttctggtctcaagaaccttcaaattttgtcatatggattaaaaaaatggtgtatgtaaaatattaagcaataatacaatcaattagatgacacacaaaaaagtatatgattaaatgctaagtaagtaaaacatacaaataatgggtctataagagagagaaattcaggtcatggaaaaggaagaagaaactggatgggtagtacctaaattggggagaatgctaaaggcattttaggaaggttaacagatggagtcaagactgaacatggaaaagagatgaacctttggtggctcactgggagtggaatggcctagaactcctttagccattgtaagcttcagtcattctgaagtacttttcattccacaagcatatatttcttttctctctcctatgcctttgctcgtgctgccttctgcatctgaaatgatttcattcctcaagctctccatttctcaaccctacccattttttcaatttaccattaacatgccaattactctatgcaacttcttgctcactctagctggaatgtaagtcatttatattcaaagagtgaattatcaaactcatgacactttttagtatgattgttaccttgtacatattgtaaatacctacagcatttaagatatggccttgcacatattaagcattctattacttgagttttcaaaaatttcagatatgtagaggaaaatactatggcaagttaatataaataaccagaaaaggagagaaatgtagaagggcaaaagtaaaaataaaaattcaccgagattcatgtatgtatattcttatttttgaacctggataataaaatgccacagcaagtcatttagtgaatctttttcattagtttaaaatttgactaatccttgacatttcttcattcatttttcatgggcttttctactcaattatagaagacataattgctaatattatataaactgagccaatacagctctcaggagagatctatagaaaatgtatcccctttttagcctctttactcatttatctgttcactactgcttatagtgagatcaattactgtaatatccaaaggcacattaaagaaccgagcaagaattgattaccagtgtgaccagaggataaagattctcagctgtactttgcaaaatggctcacctgaagatggaatgagtatcttcttatttgctttcttctatgttcttaaactaattcttctataaccatctcatccacccatccttcacccaccaccactgctccacattttaaaataccaggtcagagtaaatcctctttttgagtcttcaattgaataaaacattaatcatttctataactcagccaggcgactttagaaaaaaaaatatccctattgttttcatagcacattagaatgaaggagcggggatgtctacttctggcatcatatttttctccatccctttgtctcagtcagtgagaggtgcaggcagtcaataagtagtccattccctctgagacaccagatgctgtatgccatctgtccaagttagatattaaacataaggataaccttgcttaggtttcaccaaagagattacttgagagtaatcaaattcaaagtctatgtttaggcactggattaaatattcaaaataattagaccactatatttttttaaaaataagcccttggagagtaagtttggagagcaaatctgtcctcctcatgcagaaagcttaggggaattcatcacgccttgtgctctcatggtcccactgccagatccaccaaccaccagcctctgcagccacaccacctgccttctcccctgtaaagatccctctgggatcccatcctctatcatctctccttgctctattgtggtcctgcaacatcagcaggacctgagcagagcctcagacccccacccccactcccgccatgaacctactaaatcaactaggtccccaagtgattcattcatacagtaaaacatgagaagcctggctctggtgttcatggaagctttgttattcaatactaacctttttctccaaaggaatctacacacaaagatgtgattctggtaacttaattgttagctataaaggtgagaatgcaagttacttatatgattctattcataaaacagtatgtacaagcaaatttccatgcaagaaacttgagaaaactagaggaaaacactatagaaaaagaaagtttattttatttttaacttattaaaaccttgtgtatcaaagcattgagtgaatgaattatacctattcctaaatacagggctaggacacattgctttgtgctattctttgagtttctatggccctcaaggaatgtgttttttccttcaaaggattcaatcatgtatgtgttttcaatgaacttcaaataattgatattttgtttttaggcctcatctatccatggttgacataatgtccttttgtgttttacatgaaattcagtctcacacacataatacaattgtaataatataaaaattccttataggagcatcacataatcacattaccgtctagttcttacagctctgtgatgcaggtaacatcacaatccccattctccagggaaggggacgaggctctgagaagtctgatgaccaaaccaaggtcacgaagccagtaagtaactaagaaaccctatacataaagccagttttgttgattccaactcaatacataaatgtaatttttttcctaccaagtcagatagaatctggtaaaagagaagcttcttttacaggatctgtatttcacaaatttttgcttttggtctataataataacaataatattactcagcacttgaaaatttacacctgaaatttccatctgcaatatatttgataaaaatgtgcgggagtgggtgctttcattttaagtgggttgagaattagccctgttaataatttcttggcccggcacggtggctcatacctgtaatcccagcactttggaaggctgaggcgggcggatcaccaggtcagaagttcaagaccagcctgaccaacacagtgaaaccccgtctctactaaaaatgcaaacattatctgggcacagaggcgtgtacctgtaatcccagctacttgggaggctggggaaggagaatcgcttgaacccgggaggcagaggttgcagtgagccaagatcgcgccactgcactccagcctgagcgacaaggcaagactgtctcaaaaaaaaaaaaaaaaaaaatttcttgaagctactgaacctttcctttcatgatttctccaatttatgcattttaatactaagataatgtttgcaatgcatttggggaaaaagactttagcgcttggcagattgcagagaatgtcagttaccatattctcctttgggctggggaaaagcccctaaggaaaacaataaagtatgggacagtctcgggattataaatattcagttgctggctttttctttaaaagcaaaatgtatgaaatttataaccataagtaagctctaggtttacttagagaaactcaatgtgtatggcctgtcttaactattttccttaaagtcattttggtatttgatatttaaagtgaacggcaaatgtgttcctaggaatagaatacatttaaatactatttcctagataccttttgtccttgtattcacctggctttaagaattacttacaaaattacacaatttgattaaaaattaatatgactgctgtagtccaccaaagtggaaaaaactcataaataatgcacatggcaaactgtctaaggaataaccactaagttaaatttatggtaaattattaacaacctaggtagcatatgtgattgctactttgcccaagtttggaatgtttcttttatgaatttggaagcagtttccttcacataatctgaggtgagaaaccaaaacctatggtagcaaattggaggttgtaaatgtaccaatttatggtagtaaattgagcaaggtgatgtgcgtagcaagtggtagtgctgactggaaagattgctcaggttttcttcttgagaagaggaggaagttgtcaccatttgtgttgcttggacctccacttaaagagctaaaaattcaccttctgaacaacccaaaaatcccccttatttcaatattccgcccataatgtttatagagagatggcatatattccttcactagacatatcatgctaaatgaaaatgcacttttagtaagaaggctgtttatttcttaggtctgtgctccagcctctggcactcctgctccacaactctgtgcaggccactctgtcaaacacttcactatggaaatggctctccccagtggatgattggtataccatacttggatctgtgtggtgaactttccccttatggagagtacccatgattctagtgagaatcctaagctgctcccttcttaaaaggcatttctttttatatttaacttatttgtgcctgtgtcttgtttacctgccaaagacagacatccttgtctctctgtgcaagtatcagtgtgcacatctcattttttcccaactccctactcagtaacccaaagtcagccacaatgggagtatttacaccacagaaattagctcacactaccaattagaatattttgttttccagagagccaattgttaaacatgtcccagtatgctagtgttagaagttatatatgcttgtgttagaagttatatatccccacccctgacacctagaactcttcattctacttactctttactaatctggaaccaggatgagattatagctgaagtagtttggactatttatgttcattggtaatagagttattattaatatgaaaaaggtagactgtacaatatagtgaaagtagaattggatacggagttaaaatacttcgctattatttaaatttctgtttccaagcaaacttggacaagccatttaactttctccacatcaataaaatggaaagtataaagcttagcccaactacatcagaggattattatatgacttaaaagaagtctgacatctatgaaaacattttgaaaagtaaaattttaatatgaaaaacgttttgaaaatttgaatatcaaattgcattctttttttgacacttcaacattttcaagaatttcacatatcttatcatgactctgatatgaagacagatattattattgcaattcacatactgccagcaagggacaagatcttctaagttcttaatgctttttctgtggggtatgtgcccagtggtaacagccactcactcaactgctgatgcttcttgccctgtctctgtattcgtcaacatgttaaccacgccaaatatttaacagtgtcctagaaataaagaaaactgtatgaagccatcccaagtagagcatatgtaccttcaagttcataacattttctacatagtgtttttagtgttaaagaaaattagatgataatgtaaccagacaacatgtctttcagctaaagctcgtgatttttaaaaaaaaatcaaaaccaggatataaagtatacaaatattttaaggtatccaaatttgaggaaaaaaattacaaattaacttcagaggtataaggtatatccataaagaatgtcatgagagctcagactaagaagtaatgtgacaaaatatagaaattaaaataacagtgattttcttgtcatgaaggaaagtttagaaaaattgtaataaaaatcacacttagccaggaaaaaataacaaaaacactcaattccatggatttaatttatttcattttttctgaggaagaatgtcaaatagcttgaaaataagcccataatgaaactttttaaaaagtaacttcttattcttttgtcttggggcactaccaatttaaccccaaattctataccttccagaaaaaaaattcttattctgatatttaaaagactgactctttgtctcaattcatttaaccaagattttagtacctcttatatttatcacactggatcaggcccagtggggaatataaaagttaagaaagaagccatttctgtatcatgtcaatttgtaattgagtggtagattttaatgtgcctaataaacatacaacaataaaaaacaaataaggcaatattcttatgatggccataaagtgctatgacaactcaaagagtgaaatcacttccagttgcaaaaacaatggaattgactccttttcagaagaggtcacctgagcacatcacattatagtggattactctcatgtacttccttagacggaaaagtgaccaaatgcacttgagataacatttcccaattaaaacaagagaaaatattatttgcatatctctcaactaacctgaaaatttaactaaccaaaccatagcattccccaaaccttctggttaacttaattctactggaatattctttaagtacataagtgaatcattgatgtttattatattaatatgttcttgagaagggcctggcactatccctggtgcatatcagaactctaagagatttctgtagagggagtattgtagaaatacaatactctaagagagatgagatcaaaggcacgctcagaaattggcttgcaatacaaaactagtcaacattaaagaccaaacattttgtgctgaataaagggctgaaaacattcaggaactggaagatcagtgagcactggaggaggcaggaaagtttccatggaggaggacaacattatagctgagccttgaaggatggctggggagggtagaggatgggtattcccaggtcatcaccaacatgaacaatgctaccaagagtagaacacaaaggaaatactcatcaaacagcaagaaaacatgaatatctggacagagggttcatggggagaaccataggaaagaagattgataaataaggttgagaaaaccatgggaaactgtcacagaaatggcatttactgtggcagaaagcagtacacctaatgatatatttgtcagcatggccctgattaagtattgcactgggtctttgttgaaagcagcaagatccatgtccgtctaaagaaggagttatttttaaatgttacatgactcagactctttaggagtaccataaataatgttaccttaatagcacatggctcttctagtgaaaacactgctgtcattactgctcatgactcaatacctgtgatgctggggctggatgtctggagggcccacagagatggtcaggcaaggcagatgactctgcccctaggcttgaccaagaaccctgcctcactccccaaggccaccacttcttcctctacatctcagcaggtgcatctgatacagagacctaggtcacatacacttaccatagctgcaagggagtctggcagtactgtgatagtctctcatactctatgatatagaaaccagaaaaagacagaattatagcagaagctgagcaagacaatctaaattattgtgtgcacccaatttgataaaactttaaaaaataaaaagctgtcaacctttacataaagcctgaaatatgtgtaaatcattaaaaatatagataaggatatggtgaatgtaaatctttccttcaaaattgagagttgtattcagacatgcctatttaatgcaaaaagcgggattttttttagaaacaaaggtagcatatgtttattaccaattacttggattactcagaaatgtgcagaaaaaaagaccaaaaaaaccttattatttaactttcaaataatcactcttaacgcttactctctttgatgtgcatctgcttgcatattttaactcatattctataatttgatactctgcattttcactttctaatatcaagtatttcacaattgtgtgacattttgactatttgcagatttttgcaattataactatctctgcaattaaatatatattattaaatgtcttaatacattctagattttttttagataggtgaaattattgggccaatgcagaaaatctctttaaagtctcttgataaacattaacaaataactttccataaagcttataccaagttgtactcatatcagagatgtattcatttgaaagcacctttttggactcagatacttttatttttgaattattttttaatattatgtgtgaaaattatatgtcattgtttaaatttgaatttcttgtgttataagtcagttcaaattattttttaaacactttagcagcaagcatttttttcttttatgaattacctttgtttgcactcttattttttatgggaagtaggaaacctaagaaactccctcccttactaataagttgtataaaaagaagccagaatatgaaacttttagataatgagaaaattgcagtattctgaatacatcctgtggtggaagttaggattgtctataacacaaccctaaaattttataagtcaagacttcaaggcaacctctatttccttctacaatacagactttgagaccatgctcattggtagcctgtgaatgagtcatggtgatgacccagaatgactcatccaaggctgaagatctagccaaccagtctgtgtacaaggagaacaggtgaatattaaataagccaaaattgtaatatgaaagattaagcttacatataatgttacgtaagggataacaacactacgattggccaaaatatgcataaaatggaagaatttatttttagataattaaaatagggcaaatggaacagaagagggtatatgacctcaaattcctcccttctctaaatcagaatgctaattaagtctcagtgatgtctacctaatttttaaaatatatagaatttcagtcctaatgattattcagcattaataaattatgttatctattaggatttggaagtggagtctatttctcttatttcctaatcccacttatcagtaagttattaatttctgcctatctggtcttccaaatatcttgctaatccctgagtttacccccattgccccagccactggctttgtcctaatcaaggagactatcagcctcttcatcatctgtaccaacaatctcttcttaactggctctctgactctgccacagccctcatcaatatattcacaacattttagagagtgatctttttaaagcacaaattaaatatctccccactgcctcttgggccacatatagacaccttaactcaccccagtctggttcctccccagctttaaagcctcctctcactatgctccttccgcactcaaggctccacctatgggggaggtttttcatttcttcccaggtgttcctcaaaacagctgattctctgccttgggaagctaaggacagccactgaaaaactgaatcctggtaccaacactggagatttttggcttattgtatttggtatgaagccttggaatctgcatattttaaagctgattccactgtgcacccagtttgctattctctttgccttgaatgatgaaccctctgtggcttttaatggaattactttttattcagttataatgtagtgactgtccactatatgcaaatcactgtggcagagatgcctcatatgaattccactatttaaaataattatgacacagacatatcatttaacaattcctctgggaacaaaaaccttttcaatgaaattagcctgcgtactgagggccaagaagtattggtttatttgagcagtcagagaaggtgtatcagtaagcagctgcactatttctttttttttttttcttttattctttaagttctgggatacatgtgcagaatgtgcagatttgttacatgggtatacatgtgccgtggtgttttgctgcacccatcaacccatcatctaggctttaagccctgcatgcattaggtatttgtcctaatgttctccctccccttgcccccaataccccaacaggccccagtgtatgatgttcccctccctgtgtccatgtgttctcattgttcaactcccacttatgagtgagaacatgcagtgttttgttttctgtttctgtgttagtttgctgagaatgatgagtttccagcttcatccttgtccctgcaaaggacatgaactcattcttttttatggctgcatagtattccgtggtgtatatatgccacattgtctttatgcagtctatcattgatgcaactgccctatttctgtaaaggacttctcagtgttgagcatatgcaagtggaaatcagtgatctatgggggctggaagcttggaagaaaccagaaagcacaaggtctttaagcagagactggaacagcgtgaggaaagtagggttatttcctcatagctgagatctgtagacttgggagaagtccaccaaaggaatgtgctcccttacgtatgcattttgtattatttcttcctccagtgataaaatataaccatgggcttattaaagaaaattatttctgctttttaaaaactaaacaaatattgtacactgaagattatttaatctttctttgatgattccagaatattctgtggtcataattatgacttccaattgcttttggaaatactatgatatagtggaaagaatactaactgagcttggtcatccagtagcttcacagtctttggcaaatcatgcttgtgattcatctgaaaaataaaaataattctatgtacctcaaaaacttttgcaaaaattaaatgatagtatatagtgtgtccatcacagttcctagggcataaatgaaaccctataaatgtcagtcctctttatcttcttcctttacaatgtcgacataaaaaagtaggagatcaaaagcttaaaaaaatcagaacactgaacaacaacaaaaaagatgtaatgatttactcttgctaaaaacatccaggaaagattaaaaaacaatgacagaaatgatgtaggtgatcttttgtataactgattcattcatttgattcattcttttgtgtaactgattcattcatttctttctctgatgctattcagtttatcataacattttaaaccattttaatctttctatcatagatcttgagataaaatggaaaggataataatttttatcaaaggcataaatatatccaaaaataccaataagtgtgagatgcagcttcactgtgagttctgctttcattaattactatttgttagaggctgattatttttatctccctgagatttctctcatttcatgtttcttatttgatagactgtgttttctttctaatttatttttattttcaatatttttctcttcaagaaattgtaggctgggcactgtggctcacgcctgtaatcccagcactttgggaggccgaggcgggcggatcatgaggtcaggagatcaagaccatcctggctaacatggtgaaaccctgtctctactaaaaattacaaagaaaaaaattagccgggcatggtggcgggcacctgtagtcccagatactcaggaggctgaggcaggagaatggcatgaacccaggaggtggagcttgcagtgagctgaaatggcaccactgcactccagcctgggcaacagagcgagactctgtctcaaaaaaaaaaagaaattgtaatcttggaaaatcttcccaagtcattaaactttaaattctccatttttagatattaactaatgtttctcatctaaacaatttattatttattttgttgctccttggtcaatgataatgtgtgggattcaatcaacactaagaaaactctttgagaaattttcctagttgtagctctaaatttccagtggcctaatgtgtctccaatcactctagtttctatagtgcaagacttgatccaaaaattttgggtataatttttctatttacacatcactctcaaccattgagcttgtcatgcttgattttttctagctggcatttacaaaccttaaaagactgttttcctgttgtttcacataattttaaatatctaaacaaccttttgttcccataaaagatatcagctttattcacctttcaggcattcctaattttttgttttgttttgttttttatttctttctacacaacagattgatatggtttgactatgtcccccactaatctcatcctagattgtagctccccataattcccacgtgtcatgggagggatctggtgggaggtaattgaatcatgggggcaggtcttttccacattatacttgtgatagtgaatacatcttacaagatctgatggttttataaaggggagttcccctgcatacactctcttgcctgctgccatgtaagacgtgcctttgctgctccttcatcttccaccaccaacctccctgaccatgtggaactgtgagtccattaaatctctatcctttataaataacccagtctctggtatgtctttattagcagcgtgagaacagactaatacacagattaagagaaaaaaatcatcacttctgtaaatgcattttcactttcatggaaaggaaaaggagagatgttacttatcaataattattctcatagtaactggaaattatgagtttttcttacatgactgatttgtcacattgtatattcaataattatgctttttaattgtttcctctggactacacaattttaaagtagatttatattcaattagtttaatatacaaaacaataattcttcaaagatatttatgtcatgatactcaatcaacagaaatgtggctctgacctttttggttaagtgagtatcagtgaaattaaaattttccaaatgccttttttacagcaaattatgtgaaaaaaataaaaataagatatccttagcatttctgaaaatactggtttttatggagctttactaaccattatacatgttcatttagaccagcaatagaattgcaagttaggatgagaacataggtcattaccctggatgcatccctgctcatcacacccatgtctcatccttaactaaaaccaaactgctgttaaatcaggtggatgacaagcagcggagatcttgatcctctaagtaaatagaaatactaaataaaaagttggcatttcactggagagcagttgagtatgttaaagtaagacaatttgtgtacaaaataagtttaacttacaattataaatttttaaggaaaatcaaagttaccaaccaatacacaagtgaacaattggaggaaagcaatggattacaaggacaagtagattacaaaagaaaataatgttcactggaggaagggcttcgtcagaatgtaaaggactattgctcaggctttctacaaagagaagaaacaaagccgagaatggaatacgatgcttgcaaggtaactaggagaaagcatgagacaatcataaatatatcatattattaaaacttgcctaaaatactagatctttagacttacaacaggatccatgtgctctagcctattttaatgtttttcctgggtaacaaacaagactaatagagaacaattataacatgtttagtttttgaccatggttctttgaaacattcagtgcctagttcttcccaagcacctggatcaaaacccccatgacagcctggtcactctaaaccaatttaagactcctacagtctcatttagttgcaaatcacaggcttaattctgtaattcagctgttcaatcctatgtgacaatagaaactctctagtacatttgaggctggcattattccctaatgtgggcctatgacagaagaagtgcctacaaataaaaacttagcattgtcttctctatacttgagaaactcctccccatttgggaggagtttttattttttgctcctatgggttgttttgactgattggagtgaggctgatgatctcgtgtctttctgagcctgcccggtattcagagctgctttctctcatagtactattctgaattatttgaagacctcccacagctagagacttactgcttacagtcccttgacacaggcaatatcagtattccaactagttttggctcctcccatagcctctgagcattaggccacgaccagcttccttccgctgagatcccatctaccctccactcagtctcttggacaggatccaaggcttcctcttgtgggctttgcctcccacgtggccacacctcttcctttcccttgacaaattctgggagctccattatttaccaaattgcagctctatactctgctatcatgggctgacccagctaacattcaagctttggattcttaacgatgattcagacacaagctcactgtgccactcaaactatgtttgtgtgctttgatggagatggggaatgggagtcacataaattctccacatggtcgcttggaagtccagtttcctaaggaggtatcctcctgctcctccccactaaaagcaaagaggtgagatatataggacaactcactccaaagcaaccttcaaaattctttttctaatttccaatgactggtatctgtatgccataaatatggatgggaagtataaaggcatctaatcagtttcctcccacgccttttttgcaagttctgtgtcttggtcattctataacaaaataccataaattgggtagcttataaacaacaaaaatttatttctcatagttcgggaatctgggaaatccaagatcaaggcattggcagattcggtgtttagagaaagcctgctttctggttcatagaaagagccttatagctgtgcttccacatggtggaaggggcaagaaagctctctggggactccttcatgaggatcttaatcttactcatgaaggctctgtccttatgacttaatcacttcccaagaggccccacttcctaataccatcacactggggactaggatttcaacatatgaattcagggggacacaaacatttagaccatagcattctgcatggtaatgtttcatacctcagccaaaattttatttttcataaatgtatgtgtgtgtgtatatgtgtatctgtgcatgtgtaactaaacacagaattttaaaagatttcacaatatatcacaaacacatgtatacataaggttcagtccttcatagtgactttcacagctgtgtggtctaggaagagaaatgagtttattttataaataaccttctctcagagttgccaaaatgaaacaaaaagcaataaatttctcttagaaataagtccgcaataaaaacaggctaaaaagaaggagctcatgtaagaaacttatgtgaagaacagaaatgccataacctcaaatcctcactaagtccagggagacctgtgaccagatactataatcatgagagaaggcacagctacaaagagttaagatttgcagtagatttgctatgagcatgtgaaagagcattttaaattatgttccaataaataagttttgtgctttgggccagtggtgaaatattgatgtattacaaaaagaaaaagaaaataatttttttgttttctttttctcagtaaggaactattttttccttaaaaggatagaccaaatatcaataaagaagcagttgaggcctgtaataggatgcaagtatctaaacactcaagtgagttcaagtctcttgaaacaaattgtgtagcagattactgagaaaatttacaaatgataccaagaaacttccgtcaatgacctatgcataaggatttatcaaaaattagagaaattctgaaagtttgaaacaagtaagcagttttaaaaaaactaccaaaaattggtatttattgaatataatacaggttattaaaatcataaccttgtaatcatattgaaaggaaattggcaaccaaaaggggtaaccaaacagagtcaacatggcctccctgtttgactttattctgggtcaaagtaattgggtttctcctttaaatgtgatgacaattattgttgaagaaaaatgcagtggacatttctagatctcaacaagacaatctatttaataacattgttaaaaacaacatgaaggaatgttgaaggataatgataaaagaaagggaatttgtaacctgttaagtaactaatgaccaaaggtgctgatttgaatggatgtaattgtagagggatttactgattcacatgtactgaacacactgctgccagctttttactgaaggtaggattcttcagtttcctatttagactgagactcccagagctagtgtggtttacctggtaatgaggatagaaatgaggtcagccggttttccacaatcagccatccagtggacaaacaggtgacccatcccaaaggaatacaaaaaaggtgttctgatctcttcatcacttattactttgctccctgcaaaaatcattaacattcctgacatatggtcaatcgctcacccctgttaaagcaagtttctccctattgcgttgcaaaggcatacaaaacaaataagcatgatttctaaacaaagaaggctttcaaatataaatttgagatattatataggcttctccctatacaggcagtgtatctatggaaagaggagggccatacttcattttaaccgaaaatgcaacagtctgttaaccccgtttatttcccataagaaggaaaaaaaagtgttacatatgaagcttaaggagcctgaggcctcatggaacgtgtctcaaaatctttgcctgagaagtagaaatttagcaatatgactgaaataatagattgtattttcatttagagacaccatggctgtcttttcctcacatttctcatcttatttactaataaatttttaaagaagactgaagatatgtttattgatttacattagataaattgatttttcagtagtgtggagttttccttggtggggttttacgtcattagaacatagttcggtgagcctagacagacttcagatatttacatatctatgaagccgagtcattaatcatgcagaaaagttcaacatagagagaagttgctataattattggtggcaaacaattgaaatagattcatgctaacttgaagaaaggaacttaatttttggaaggctattcagttacagaatctaagaaagagtatagcatccaggccaacaggtcagagctgggactctgattaataggaaataatgggtaatttccttgagtcttgccatcaaggcagtcttctgtctttaggtaactcttcccagcttcaatcctaagaaagaaactctgatggggtgggctttagtcgcagtgttacactttagctatgctaggggctggtggcgatttctagttataatcggaataggacctcaagaaatggaggttccacgaaagaaaactattgccaggtctctttctcagaagtggggacaagtacactatgaaaagtatactttaaaatgggttcagtacctttatagtttgaacattgtacattaatggtaaggctctaattatctaattgggtaatggattcataagtgttcatttctcttatgtaaataaataaataaataagaataaaagagagccatgcatagactaatgaaaacagtgttttaagaattaaccgttatgattaatataagcctgaaatacaaaaataaataaaatcaaacaaaataaaaaatattaccctaaacatcagacaaaaagaaatcaaaactgagcaggtacattttaatactttggataatttatattttactatttctggataacaatgataaataatgaaatgatcaagcagtcagaaaattctcctaattcaagtcttcctgaactacttttgtaagtcaaaaatggcaagtttgtcttagcaattcttgatcttcagctcttttatatcaatattagaatgagtttctcaaatttagcaaatacatacacacgaagagacacaaaatctattggaactttcactggaattttattttgtttatacattattttcaggatactcaatatttatgccttcatttagttttcttattcataaacatcctatctctcacatctcttctcattccatctcatcctattttgcgctatctctccattgtcatttttaatattcttccttaatgcttaaactttctttgtagagactctgcagaatatgttagatttattcctgctgaagtctgaatgtcagttccccccaccccgaccccctcaaaatttttatattgaaacttaatatccaatgtgacagtggggcgggacctttgggaaggtgattttgtcatgaaggctgtagccttataaatgggattagtgaccttataaaacaggctcaagtgagctctctagtcccttttttgagtccctccctccatgtgaggacagtgagaaggcatcattttggaagcctctagaactgagagaggctgaataaatttctgagaaataaatttctgttgtttacaaattaccactatttcagtatagcagcaggaatgaactaagacaaattttaagacactttatagttttttttgtcattataaatggtgtcttttcctttaaattattttatttaaagtttattactcgtataaagacatgcaattgacttttctatggttaagcattttgctaagtttttctatcatttctagttatttttatgtatagtttttttggttgttttatgtatacaaccaaatcattttcaaggaatgatggttatttcctctaaatttgtatgcttttatttatttatttttattgcactaactagaatacccaagtcaatgtaaaccaataaaatggtaaaagtaggtatctttgtcttatcttatatttttaaaaaatcttataaatttttatccaatttagatgttccgtatttctttcttttgcctaattgctctgactacaactttcaatactatgttgagtaaaagtggggaaagtggacctctttgccttgttccagatcttagaagaaaggctttcaattattctctattcataggatattacctatggatttttcatatatcacctttattgttttgaggtacattccttctatgtctagtttgttaagtatttttattatgaaggaaagttgaactttatcaatgtgttttctgcctctatggagataatcatatggtttctgtccttcagtttgttgatgtagtgtatcatagtgatcagtttagatatgttgaaagatccttacattcctggaataaattttgcttgatcatggtgaataacctttctgatgtgctgttttattcagttttccagcattttgtgaggatttttgcatctatctttatcagggatattggaatgtactttcctttctttcttgtgtctttgtgtggtgttggcattagggtaatactgaccttgtacaatgaatttgggagaactccctcccacgtaaattttttggaatactttgataagaattggtattagttcttctttaacagtgtggtagaattcagcagtgaagccattcagtcctgaacttttctttcctgagaaactttttaattaatgattcaacctctttatccattattggtctgtttagttgttctgtatactcatggttcaatcttggtatgtcatatgtatccagaaatttatctatgtcttcctgattttctaatgttttggcatgtaattgttcataatactctctaatgatcctttgtattgctatgatatctgttgtaatgtcacctttttaatctctaattttatttatttgggttttctctcatttttttcttagtactctagctaaaagtttgtcaattttgcttatatttttaaaaaaccaactttttattttgttgatcttttgtaattttttagtctcaattttatttatttctgctctgatctttattgtttctttccactaactgggggtttggcttatgctcgtttttctagttttttgaggtacatcattagattgtttatttgacctctttctacttttttgatgaaagcatttcttgctataaacttctcatctctcttcataatctttttctgtatcccatagattttggtatgttttgtttccattttctatggtttcaaaacattttttttaatttcctttttaatttcttcatgaaccctttgattgtttaagagcatgttgtttaacttccatgtatttgaatacagtttccaaagttcctcttgtcattgatttatagttttattcaattatggtcagaaaagataacataattttgacttttcaaattttttgatttattttttggcttaacacgtggtctatcctagagaatgttccatgtgccaacaagaagaatgtgcactctgcagcagctggatgaaatgttctttaaacgttggttaggttcatttggtctagagtgcagtttaattctgatgattatttgataattttcttctggatgatctgtcttgctaaaaatgggatgtggaagtcttgtaccattattgtattgcagtctatccttttaggtctgttaatatttgctttatgtatctgggtgctttagtgttgggtgcatatatatttattattatatcttcttgccaagttgactctgttctccctatataatgaccatctttgtttcactttatagtttttgacttgaagtatatttcatctaacatgaaagtatagctactcctgcccttttgtggtttcaatttatataaaatatattcttctattttttctatttaaatcatgtgtctttatagatgaatttcttataggcagcatttaactgggtcttgtacttttatccattcacccaccctttatcttttaattggggaatttactccatttacactcactcttattattaataggtaaggacttactactgctattttttttttgttttatggttgttttgtagctcctctcattcttcttttcttactgcctccttttgtagttattttttctggtagtatatttcaatttcttgcgtttgctttctatttttagtttttatattataggtttttgctgcatgggtatataaaacatttatgtttttaacaaagttattttaaacggataacaactttattttgatcataaagaaaacaataaatttaaaaaaaaaaactaaaaatctctacactttagctctattccttccaaaattttgactttttgttgttccaatttacatctttttatattgcctatctcttagtaattttctctgggtatttactttttccaatgatttttatacttcaggtggattttttttggttgtatgttggtatccttttttgcctccagattgaagaactccctttagcattcttataagaccaatgtggtgatgatgaattttctcaacttttgtttgcctttgtgtttcaaggatagctttgttgggtacacaattcttggttgacagttttttttcctttagcactattagtatgtcatcccacttcttcctgtcctgtagggtttctactgagaagtctgttgccagacaaatcagatctcttttatatatgatttaattttttttctgcttttaggatcctctatttgtccttgaactttgagagtttggttattatatgccttggggtagttttatttgggttaaatctgtttggtgatctttgaccttactatacctggatatttatatctttctctagattttgtaaagttttctgttattgtgtctttgaataagctttctaccccttgctctttctcaactccctgttaaagaccaatgactcagatttgctctttttaggctatcctctagatttgtaagcattctttttgttttcttttttctcttttatttatttccaaattgcctattttccagatcactggttatttcttctgcttgattcagtctgctgttgagaccctctaatgtatttttcattttgaccattgtatttctaagctccaggatttctgtttgatgttttaaattatttcaaaatctttgttaaatttctcataaatttctgaatttatatgacaaatcttgaaattcaccagatttccttacactgctggtttgagttattgatctgagagctttcacataaacatcttattagggtcagtgctgtctcatttttttgtccatttggggaggtcatggttctctatccactcttgttttctgtggacttatgtctatgtctttgcacttaagggagaattatttattctagtctttgcttttgccttggtctttccagagtatgtctgtctgtgcaggttgactgatgagttcctttagcccaagaccactgcctcctttctggcattaggtggtttcctaagcccagatttgccataactcttgaaaaagttcagaatactgcacatctcagactgcggggatcccagtggggataccctggctgtgtaagaaggctagtttggagtttgtgcctggaatattcacagagcacacctttgacagcatagtggtcatgtacagcctctctaacttgctgtctcctttggctgagatgaaaagcagccacagagttttgcatgctggctcattttagcccaacttctgtttgtctccagctaccctcaggagttttcaacctacatgcacttgcagtacttcctatgggttggggcaggaatggttttcttgccaaggaacccatgatggtggggaaactggctgtctacctctattacacttttacctgtgtagaaaccatcagtccacggggacttttccacatgttgcctggcagtttgggggaggggtgtcacagttagagttttattcctcttaccttctgctcatgatttttcatttttctgtggcccctgggattgtcacagcctctgttgtgagttttagaatattgtttacggtttatttagatagtaagaattgttcaaaaaattcttcaactttaaaaattttctcagaagattctgccaagtaggcatgtagtgtttgttgtagcagtgacaaactaccacaaatcagtagtcagatagatctgccctattgacacacctcttaaaatcacaagtatagtcctgccactaatatgcagcctcttttcactacttagaaaaagcaaaagattaaatcttatccagcacacttttgaaggcataactgaaataactaacatgggttaaatccaaaagaaaggtattgcttaaattcattttcaatcaactcatcataatgtccacttccaaaacctctttgttaactgttgttaaaggcaaaattattctgcatttgttaaaatcgtaaggaagactttattcagacctgtcaggtctattgtgacaggtgtcaagactgttgtaatagagagggagattaggctcaactccaaatacagcaatgacagctggggatttatagccaacaagcagagtaattagaaaattactaacaagagacatcaagtatagggggattcttgccaaactgtttaacaggattcttgctgaaggaaagccatggtgatcagatatcaagggtgagaagattctcactaaactgagcagaattcttgttacagttgggctatgtaggtccagcaggggtggggttggggagagccaaagccaaggtctagttgagaagagggatcaaagaaacctgactaaagtttggtcaaggatagatccttgtcacttggcttgcatttgataaataatataattctcctcaccataaaaacaaaacttttttctcctcgctttgttgcccaggctagagtgcagtggcacaatctcgactcactgcaacctctgcctcctggactcaagcaattctcctgcctcagcctcccaagtagctggaactacaggcacatgttaccatgcccagctgatttttctatttttagaaacgtggagttttgctatgttgccaggcaacacttcgtggtctcaaacccctgacctcaagtaatccgcccaacttagcctatcgaagtgctgggattatgggcctgagccgccacaccctgtcaaaatagaagtgtttataatgtttgtagtacaggtgtcatccaggcatttctctaccaatgtctgagcagtgagtctgtacagtttatggttaagagcagcaactctgaaactaaatagactgggttcacatttcagttctgccacttactagctgaattaccaaggaaaatgacttagcctgactctcccacagattccttgtctgcaaaataagaattgtcataatacaaaccacaaagggggaccttaagagtaaatgagccaatatataggaagaatctgaacagtgtcccctacatggtgagccctagtgattttaaccattattatttgtaagcttttgatttgcatacagaacacaatttcttcagtggttttaatgaaaacatcttattctgaccatatcataattgtatatcttctgctgaacagcacaaagcacattacatgtttgtgaaaaatcttcatccaagttttctttttttccaattcagatctctttcaaactctttacttctttattgtgcatttgttatttgagatgccttaaggatcttgccttctaccctaagtgggatttgaaggcattttatctttttctggagaaaaaaaattgctgagttcttctgaaaggcattcttttgaaaacaattttttctatattgttctattggcttctattatttatgtccctactccttcatttcatgttttaccctgggtgatttcatgcccacatgcatgcttgcgcaccctactcaaaagagttgatgatcacatgcaggttttctctccttctggccttcttggtctctcctctcccctcatattcagagtcccaggcctgccagagcccagcaattctcttctccctctcccctccaagcaccccatcaaacaagattggaggcagtgctcatggacacaatcagtgctgaagagagaaagttgacaaagaataatggaagcagggaaaaagaagtcatgccacataatgcattttagccagttgaaaaagtttatggtgcatcctgtagttcagaaaagtgctttgaaagaaagattttcattcttgccagcccgacttaccatgatcttcctttaataaacacacaacaaagggtcctgtaggagaaacagctgaggctgagctcagtctgtggataaaacaaacagttcagagactgtcagcaggtgagctttgtttttgatgtgtttattctctgaagtgcctgagctgtcagcaaccagggccctcaacccagacagctcccctgcctaccttcccacagtgtggggaaaggctatccataaagcagggccctaaatgatctttaagataacttaaagacatactgatgattttgtacaatagcaaaataaaatcaggatgaattacaaagttaaatgttaaaaaattgagacaatagggtgttttgaaaactgaacagtcaaccaagaaatcataaaggtgtagatcgatagatttgatatatataattaaagggaaaaaatgtagatgaaattgactagaaaaacaaatgattgtaccgcattgacaagcaaagcactaacatttttattattaaaggagttttcacatttgagcaaaaaatgatgaacactaaaaggttaaaaaaagctggcaattcacaaaaaaatttaatgacaagtaaacatatgaaaagcattaaacttcactaaaaattaaagagtataaattactataatagatacattaaaactcatacatttggtgataaacttttctaagacaatttatattgttggcagggtgtgagagaaaaggagcattctaatcgtttgctggggagtgaaaattagaggaacatcttgagaaagcaatttggcaaactggaacaacattctaaaaaatgttcttatattttgattcacatctatttatttatcatgaagaaagcaaagatgtgttaaaacacacacacacaagcataaggattttcatttgaattctatttgtaataataaaaagttgcaatcatgaatgtacaagaaaagaggaagttaaaatagctatgtcttaaatacaatgaaatatcatggaaatattataaatcaagttttcccacccagtgtcaacagcaaaatgatatcttaacactcaaggaaaaataaaatacctctcaagtagttatggaaacctcaagctattttaactcgatcagttaaaattatccaactatgtcttgctgttttgattccaaatttataaaaactgattcaaacctgtattgggtagttttgtgttgttttgctgttataatttgcttctaggaaaataatatcttcaatttggaacatggaataagttggacccacttgatatgtaatttttaataaaattattaaatcgataatttttaaagtaaacttatattttatgaaaatgtattcaaaatatctgatttccccaaatgagtgctagaagaaaaaacaaggtaaaagcccatatttagcagtacaaccttagttatgttaaatatttattcaacaattattgaacattcaacaaatagttattgagctcccattgtatgccaggcactcttataggtactggggatacaacgaacaaggccagcaccaactgaaatatctgccttcattgagcctgcaacctagagagagagcaagacccttcttaataaacaaatgtgtaatataaaagaattttgggaagtgttctagggcaaaataagtcagggaagagaattggggtgtatgcggtaggaggaatgtgactgaattttaaaacaagtaatcaaaaatcacctacgtgacacttggtcaaagacctaattgttgtatggttgtgagaaagtcagcctgtggtctgggaaaagcattccaggcagatggaacgccgcgtacacatgtcttaggtgagagttttctgatgggttctgtaaacgtatagagattactgcggctgaagctgagtcaatgaaggaagaggaatgggctcaggtcctttggagtcctgcagccctttgaaaggaattgtccttttattctgagtaaaataggaaaagaagattctgagctcagttgtggcacaaactcagtggcttgcatttcaaaggaatccctctggcttttgggtgaatataaaataaagggagtcaaaattgaatgtgtgccgggtgaacaaggtagggttccaggatgattccaagggttttgacctgaacaacaaaatgataagagttctccattcctgaggaggagcaggttcggaagggacttttttgtgaacatattaatgtccaaattttggcacacgaacacattagatttccaagtagatgtgctgagtgggtagttacaggtatgcagatggacttcaaggaggcgcagtctgagctagagacaggcacaaagtcaacatacatatggtcttaaagtctattaacatagatgaatttaccaaaggatgagtggagaagacaggacgtccacaactaggcccttggccaatccatccaagaggtcaggaagatgaggaggaagcaaaggggcaggagcaagagcagcaagggaaacagaaggaaaaccagagctatcccggaaggcaggaaaagagcacttcaagaggacagagtgatcaactctgccaggtaacatgacagctaagagtgaattaggtaggtttaacaatcaatatttttccatgtagatttctgtgtaggcatgtagggttgggtgtgtttgtgtttgggtggatgtgtaaatggaacgccataaagaaaaacattaatagtggttgaacatgtattgcactctaagaaaaaaacttgctacaagtaaaatataaggaaatcattagaaaatttatgtaacaatgtactataagttattttcaggagcttagtagatttgatcattgatgccacttttctttttagtatactttaagttttagggtacatgtgcagaacgtgcaggttagttacgtatgtatacatgtgccatgttggtgtgctgcacccagtatctcgtcatttagcattaggtatatctccaaatgctatccctccccactccccccacctcacaacaggccccggtgtgtgatgttcccctttgatttaccattctttttacattaaggatgctacttttttatgaagaaaaaataatggaaacaataaaagttctggtggtccttgaggtaatatgagtgcctttcaccatccttccttcattagatcacctcattttgatgtaaatgataaaacaagttaccatgtgagatttatctcacagaacctctgtgtctgtgccatttgtgaaacaagattgttaaggggattgaatgagttacattatgtatgcttgtacaacaaggcctggaacactgtatgccttgcataactatcacctgtcataattatttgttaaaaagttctaaatagcaaaacattgaaagagaagccactgacatataaagttgagaacatagattttgaggctgaacataatgagtgtaaatctcagttttgccacttgctctcaccaagaccttgagcagattatataacctctggcttaatttccttacgtgcaaaatgaccataaaatatctattagactgggaagttggaatctttacagtatgcagtatgtctgtgtcttagaaggtacacagtgctccctatctttagaatttatatttgaaaacttgttgttatgacataaatgcatttcagttagtttttttcccctaggtaactatacaagaaatttaatactgttacgtgctgtatcggtcactcttctccagaaaaacaaaaagaataagagaacaacaaaagaataagatgtgtgtgtgtgtgtgtgtgtgtgtgtgtgtgtgtgtgtgtgtgtttagagagaaagagaaagatttattttaaggaattggctcacatgatcatggaggctggcaggtccaaagtctgcagagtgggcatctagtgtggagacccatgaaagagccgatgttgtggttcaagtccaaaggctgtcagctggcagcattccctcttgctgcaggagatcagtcttttattcaacttaggccttcaactgtttgatgaggcccacccacatataaagggaaatctgctttactcaaaggccactgatttaaatattcctctcacccaaaagcaccatcgcagggtactgtggtcactgtggcccaaacatgttgatgcataaaattaactgtcacatcttctttttatcagaaagtaatatgaaaataaaatatggtcactgaatcatagatttccctcaagtcagaaaccagggagtctgcctatgcccattcttctctctaattagtcaacaaagcctgaacatggtgctcctcaatagatctcaaatccatccctgatctccaactctgttgtcatcgttttagttaaatctgcccttctttctcatctttactaatgcaatagtgtcagcttatcaaactgtaggtttctttcctgttagactcaagcttgagtgtagagagctgttccacaagaaaaactgagggacttgatgggtgcagtggctcacacctgtaatcccagcactttgggaggctgaggcagatggatcacttgaggtcaggagttcaagaccagcctggtcaacatggtgaaaccctgtctctactaaaaatacaaaaagtagttgagtgtggttgtggtgtacgatgacagactggtccccaggaaataagagggtttgttttgggaaagggatattattgtttttgttctaaactataagttcctcacaaagttagttcagcctacatccagaaatgaacaaggacagcttggaggttagaagcaagatagagttggttagatcaaatgtctttcactgtctcagttataattttacagtggtggtttcacaccaaacacacacacacacacacacacacacacacactcatctgctaatttaggttctggttctgttacttaactattggctcttgagcaagtaacatcactgatcctgcctcatttacaaaataagaatcataatgatcgtaatacctacctgacagagtaagaaaggcttcaatacaggcagccataaagcaaaacattaatagtggttgaacatgtattgcactctaagaaaaaaacttgctacaagtaaaatataaggaaatcattagaaaatttatgtaaaaatgtactataagttattttcaggagcttagtagatttgatcattgatgccacttgtctttttagtatactttaagttttagggtacatgtgcagaacctttcaatcaatacataggccatttaaaattatttgtttgaaactcagtattcaggaaagcagcaggataaattgagaggagtgtggggaaggtctgctggtggcaatgggtgagcgtaagggctatgccatcttagaagactttatgataaacacttgccactcatgcattttaacatgataaaattgtgatccaaatataaaattttgtgcatttaaaggacttgaacatttaggtggactattgagatttctgattctccataatatttctttttccaccactgctaaacctgacatttacttcaaaaaaaaaaaggaggaaaactaatcaaattctgtataaaaggtcaacaaaattcattaagatcttctggtttcagatttatacagaatatctaatgatttcaacaaaaaaaaatggtgtatctactacttgaggccaggaattatccttttggggtctctactatgatttagactgtctcttttattaggcagaattcggaaaaactcttatggacattgtcctttatgaaggtagtaagaaaagcaacactggtgtatgtggcggcagggtgtgtgtggggatgtgcatgggtgtatgcacacacacaagtatgtgtggacatgcctgcatgcatgcttagaagaaccaatgttgttatggttctgtgatctatgtctctatgtttccattaagatgagaaaggccagcataaaagagtgcaggttctgcaaacagcaggcagagatactaaactaagggtgaaaggaaataagatttgtgacagcattttgagaagcacagggtactctccaaatgtaaggaggtggtagtattgtggtattcttatcactgctagtatttataaataaccagaagaaagcaaacatatgtcttttatattcagagaccagttggtcaggcacatatttttcttacatttcagtgcataattaatgacattataaaaagtcattcttagttaacaattctatttaaatcctggggattgatttatttgctactttttacaatgaaaaagataaccaaatggtcctgtttgtagttgttagatccattttcagtgacatttttggatctgctgttggtgttaaaaggtcttgcatacgtttgtggactaaatgcaaagaactacatatgactttgtgagttaatccaaacaaactaagtacactatgttacttcatgaagtaattgtttaatgacaaactgaagttattgttctcaaataatcctggtatttagtaatttatctatagactggcgttcagatgctgtgaatggtaatgagagagatcacatgacgaccagctttccacaactgtagcaatttggcagttttgctcccgcaccccaccccaacaaccccagggtgggacatttggcaaactctagagattttttttttattgtcgtaactaattgggagaggtgctggtggtgtctagtctatagcggctagagaatgctagtgaccatcctatgcacatcctagacagaaaaacccacacaacaatagctagctagtcagatgtccatagtccctgggctaagaagccctgctgtaagccaatgcttctcaaactgtagctcatggagcagcagccggatccccaaaacccagtccatgttatgatgagcttaccgaaatgtaaatcaactaggtcacagagtagttcagctgataggttttataataaggctctcaatgaaggaaagagtgtattgaattacatcttgatgaaagctcattatctcctcgatgactgacgcccagagtacaactgttttatcaaacattcccagtcgctcccttgggtggtctctgctcactcccataacgcggcccatgattcttcagaggataaatatatccctagacccacagcagaccactttacattgtcacagagtattttctgaacgcttaaccttctgttctgtaccgcattaaggaaaacaaagattttaagtgggctttgactaaagtgtatgcacttgtaaaatgcaaaaatcacagcagaatttaaaaagtgtacaagtcaaaaattatttgaaagagaagtagccatcgctactggtttagtaagtctaagtccgcctaagtctcactatggaaaagacaatttagttattttctctttagtcacccataattgttctacaaattccttgcatagttggagtttatgtcatttttcatatgctatgtattttcatatattaaaatgtggctgataaatatctgttgatataattgattacagaatcatagttttaagtcagcaccaaatacaaaattttgtggatgcccctatatattaacactgttaagaattaaattcctgggcctcacacctaccagttttaaatatcaataacccattatgtgaatatatctctaagttacaaaaaattcagtgtcatttaattttcagtagccaaaataaagccttagccaaattaagccttagccaatatactttatacttttaaacacaacttctgaaatactccagtaagtttaacattggaattataccaacaaaagggcatcaggctagaaagagtttgccccttaacacattctatgtaatcattgcaccatgaggaaagctatatttgctacacttgactcaaatttgatctttattaaacgggaccaaaagctatttcccagagaatgggcatcaagtggtcaatgtgctaacgcagtccacatgaactatagcatatattggtgaaaatgaacagtgaaaagttgttaagaatcaataaagatggcagatgagcaccaattggtgggctgaaaagaaagcggggaaaaggaatgcctattttagggttgatatacattggaaaatccagaatgaatgaaatacaatataccaacttgctactacaattgccagcactactatgtgtataggatacatcaacacacagatattggaagagaatataaaaagccttgggaagtaaagggtttctaagccatgaatagaactaatgccataaagtgacttactaaatggtatcctggtgacttgaaaaattaatacattttccaaaagtctgaatggactccccaaaatatactgaaaaacagaaaaaccctacgagactttaaaggataaagaaatcacagcaaagtctcctttcagagattaagggtgtgtgtttatgtgtgtctatgtatgtgtataaatgttctacatttttcgttctaatgattgatttaccagttcagtcactcagttgtaaaagcttttaaatttatacaactatagtttcaaaattataaatgtcagcaacataactatagtataatattaagaatgtttacttacactggaaactaggtggtagaatgatttgttttatatacatctattaaagttttggttggaaaaaatacataatctttagcaactgaataactgcatttctattgtgcagataattcagaagaatctacttcatcgttatgatgattcatgactttaaaagagtgaagatgttaatattttgtgctaaatatacatttcctgatttatatcatgtcatatcataatttcaaaatgaaacaaatatacacagtaataaataatatttaacctttaaaacagtcatctgggcctggtacagtggctcatacctgtaatcccagcacactgggaggccgaggtgggcagatcactggagaccaggagttcaagaccagcgtgggtaacacagggagaccctgtctctaaaaaaaaaattaaaaaacatatgagccaggtatggtggtgtgtgtctgtggtcccagctacttaggaggctgaggcaggaggatcacttgagcctgggaggttgaggctacaataagccatgatcatgccgctgcactctagcctgggtgacagggcaagaccccatctcaaaaaaacaaaaaaaaaatcatctgtaaatatggaaaaactgtcacatgtcaaaagaatcccatatttggttttgaagtcaatatgctaggcagaccctgagtgttcaaaatggtgcatcagaatcagaatctcaggatttaggagtcagtttattattttttaaaatcaacttttaaaaaataacagcaatagaccatcatcttcctattgctgctgcagattcaaagttttaggaataagagaatcttctttaaaagataaatttctacacaattaaggcaatcacatatgcaaagtgtttgtaaaaacaactcattgagttgttcatttagcaactcaatgaaacactctccaatttatattacatttaaattacaacatcacaatgggcaaatggccagacacctttctttcgaaagacatcaaaacgagttacccttgtaggttaatttttgtgtaattgcttaataatgtatacatttaagttatagttgagcacagcttagaaaagaaactagtagccaaattagccctttctactttcataaaaaccagacatactcaaaatgaatcaggcctgtctgcacacccaaatctcagaaacaagcatgaattttcaaaatgcacacatagtaaaaaacattttaactaaggacagaaaaacccgagttttaatccttaccctaccatttatttagctggcaaccaagaaccaattataatactcctttaagcctcagtgctgtcatttgtaaaatggagaataaaacacttttataactttttgatggagataattgaagcaatgtatataatggatatatccctatagacaaacatttaaaaaaaaacactgctttctcctctactttccttattgctactagaacacattcttataaagatttcacaacttctaaatgcaggtagaaaattagaatagcatacttgactcaggacgggtggtgtggcttaatgagagcgtttgccaaatccttagatataagatatattttatgtaatctatgattactacaactgttaccaggaagaggtctggatccagaccccaagagagggttcttgggtcatgtgcaagaaagaattaagggcgagtctacaaagtgaaagcaagtttattaggaaagtaaaggaataaaagaatggctactccacagacagagcagccccgagggctgctggctgcccgtttttatggttatttctgatgatatgctaaacaaggggtggattattcatgcctcccctttttagacaatattaggtaacttcctgacgttgtcatggcatttgtaaactgtcatggcgctgatgggagtgcagtagtgaggacgaccggaggtcactctcctgtccatcttggttttgctgagttttggccggcttctttactgcaacctaaatataggtctttatgacctatattttgtgctgacctcgtatctcatcttgtgacttataatgccttaaccatctggaaatgcagctccgtaggtttcagtctcatttgttacagggcttttccttagttcagctaatgacggggtccttgtccgtccaatggccatgaaaatttaggctcacagacagtttaaagggtgagtaaagcagggttttattgagtgaaaagggaataaaaaggggaaacagggatcctccgcaaggccagagtcccctgctagagtgcttcccgcccgccattcaaatcccacgttccacacaggaagaggaggggccaggctcctcactgctgcaaacatcctgaacttcccgaggctccacctcagtgggcaagctagttagtttctccaggttcccccctcccacctggttgtctcagttttacccagctcctattcaagatggagttgctctggttcacgcatctctgacacaaatatgcagaatttgtccacaaggatttttcccctggaacaccagaataacattgcaaatgaaaaacttcctctaaatcaatataaacaaaaaattaaaaggctgactatattaattttttaatcaaactaattagggatgtagacagccctgtaggatctgagtggccttattcaatgcattactctttagtagtaaagaatcagaaaattattttacctctcactgttagccaatgtcaattaaaatattacctccacttattctacctttcttatctaaagaaattatttgtgtgtttgtctttttgttttatcctttgggagaaccaagagtcagccttttaagaaatcagcttggtgctatacttttcatggttgattcctcttaatagaattagaattatcaggtatcttatgctttaaatgtagcatgtcaccatagaaatggcagaagaaaatattaagtatttctccttctttctgtctctatgttcgggaactataaaaatgtattcagtaatagaagtgcataaaaaggatgataagatggtttgaaaaacagaaggatgcttctaaattgctttgtgaatctaaaatgttatggcataaatgtcacttattagtcaataataacatttgaagagattctaacccaagatagtcatggattttattttcagcacatctttctttaacatttattccacaatgataacccttggaaaccaaatacttggaagaaaaggcaagggtaaagagaagggggcagaaaataaaagaggaagagaatatctacaaaggtatttaatcctttgaaacaacttcttcttagcatgaataccaagaaagaataaacaaactttcttatgtattaaaattagagtttctttaaaattgcagaaatattaatatagaaaggaagtgtttcaagttttaaaaaacatagggaaactatcagatgatttcaatcttcagctttcttaaagtcttccttagggaaagaccataccaggtatcaatagagttggttacagctatgccataatttgtgtgtatgtgactgggcatgacagaatcattaaggcctaacaattctagggcacatttaacagtgggttgtcctgtattctttgtcagctcaaatgaatgctgtgagtagacaaacacattaaatgactgtcattagattcatctaaatcaatactttatgtggtcttttagatgcaggtgcaccaaacagcactctctctctacttctcgttatgtctaatcaagcactgcatatgcagtgcagctagagtggtagggataatgaacttgtgttaagcatttttccaagactccactgccagcatcattagggctttgctaaatagaagaattttgttgcttagtaacacaaatattgcaatggaggtggcggaaggctttttttttttttcccaaaatcgtgactccctaatttactttcagtcctgcacgaacagagttctgattaatgatgtggctcctttctgtcaatgtgatcagtctatcttttgtgtacccagcaatgtacaaaccaaaccccagttgtgttagaaatctttgtctttaatagattcaactctcttatgtttttatcagcctcaccactaaaattaaaaagcagtatcctcacaatactctagcccaggtttaattgtatagaaatatactctaaatgggggttccatttcttaagtgaaacttgtatgcaatctgaaataaataaatatgacatgtacatatgacaaatacatggtgataacaaagtaacaccccttctaagaataagctttataaagcattgataaagttggacaaatctttagaatattttttacattttaaaaataatcactctaatgtgttctttgactccactgagacacaaatccactttcataaaatagcttgagtgagtctccctctctctttctctacctccctctctctttttctctcaggaacattttgattttttaaaatgcatgtgaatatacacagtaaaatgcaaatgaaaatataagaaaagatcagaaaacatattgaaaaatgaaaaaaataattttacctacatgtaccataccataagtgaactctaaaattggctctagccttctggtcaaccaaggcaaaaaggaaacagtatgccttgaacaaatcttttgaataaatatattcttttgaatttgtgaatgaatacaaacttttcccagagctaacattaaggagaaatttagcaacatgttggagagtcagtttctgcataagttttctattgctgccataacaaattatcatatgctttgtggcttaaaacagtacaattttattatcttccagttctgtaggttagaaatccaacatgggtctcactgggctaaaatgagggtgttggcaggactatgtcacttgtggaggcttaggaggataatccattttcttgacttttctaacatcaagagggtgcccacgttctttgactcatgtatatcagcctccatttcaaacccaactaagttgaatttctccaaccactcttccatagtcacagttctctctctaaaggatctgcgtggttaggttgggactacccagataatccaggattatgtctccatctcaatgtccttaattttaatactgtaaagtaacatattcactggtgctagagatgagaatgtggacatcttttggggggccaatattctactaaccacagtatgatataatgaaaaagaggacctctattgtcagacctgaatttgaatactgcctctcacaattactagccttgtggccttcccatacttatttaacctcatgggtttccatttcctcatctaatcataggaaattataatatgggatctaagatcttgtggaaagggatatgtcaagtacttagcacagagctcaatacaccatagttactattgttttagttgatctttatctttttttatactgtcctagcacactttttttttctgattacttagtttgacagcaagataaaacttttatagtgccttgaagaatgaatggctaatgtgttgcatcaactctttctcttaaatccccatttcctcaaccatattttttggcagatgccaagtaacaatcaattaagtttcagctccctggtagaaatccaatgtgtaggtattatgtattattgatagtagaaaaatccattcactttaggtatcaaagagtgaagtggtggtttaatattctttttgtgaaaaataagtggcctaacaaattttcttccagaaaaagaaatatatttttgagccacaaaagtacctctgtacaggttcactgatatgatatatcagtgaacacgagagatttatagggataataatcgtacttacttcataaggttgttgtgaggctttctcagcaaagctctgggtctggcaaaatgtcaggaaaccatgtgaaacactggaaagataggttggccttggtaaagatcataagtcaccatgtgggagcagtgtgatatctttccaaaagagtgaacagaacccttactaattccccagtcctgtatattattgctcaaacctgcgtcaccctattaaatcaatcacttttgatgctatttagaaatgattctagatttcaatccttcttctcaacttctcccacccacatcatcagtcctttatttcaagccattagtctattatacaagatatcatttggaatttattcaaacctaagcaacacaaaatccatcctatagtagcttaaacaagatacgctttttctcacgtaacataaaatctggaagtaaggaaactcaggactagtgagcagtcgatgattatcaaagacccagagtcacccatcatgaatgacaacacctttgtgaagcatctctgaatcaattagttgggctctctccctgtgttcaactttgtatattagcctttgcacaactgtcttgtgctttttctgtttccaagtgtctcccacctctgcagtctgagattgcttaaattaagccttcctatgctcttcctgacacacagcaagacctcaatacatttgtataaaaattaattaaaatgagtgaattaagaagggaagttattgaagtggttagccaagtactaaagaatcagtttttacgtcaaaatatggcaatagacccaaagtttggggaaaaaatagaaatgattcagaaacctgagaaagagaaaaagaaataaaaggtgaaaagctcaaggaatctgggattcaagaatcaaaatgtgaaatccaggaatctgggcaccaagaagaagagcaagaaaggagcttgaacatcatcagggtgctaacaagatatcacctgggctctccttcttccaggacacccagacatgatttcacacaatttttcacatgcaatggaagtcttcgtctcccccaacagccaaaattttctgggtttttttcaagtatttttcccctgtctccgtgcttctgttagtactgaattagtttgggtcatgaattatttctctattccatatagcattttaggggtaattctcatctcctaccttagttctttggaaaaatccatttaacacaacatttgcatgtataggagacactacagaatatctatgaggattaatgaggattttaattataaacattaataaaagcaacttccaactgaatattacatagtcctagtactaagtattttggctctccgtgccacccccaaactttttcaccttctactgtactcaggctccacacattcttctagttttaggaatgcagaatttctcagagcatgtcaggaaaaatattactcctaaacttagctttgagtccactgtgcttatctagatcaaataaggatcttcttctcaacagatataaggggttgtaatataactggagagactctttatcaaagataatcaaaattataaacagtataaatgttcctaattaggccaaaacgttgagagactatattcctaacttaagataaaaattgggttgaaaatattgtcaaaagttagaattaggtgtagaagggttagagataggcttagagtttcttgacaaatgtttaacaatcttgcgttctgctttaaagaggtctggatttggttaatgaatgataaacagtcatttcctcatctgtgaaaaaaattattcattctgctaatatttgtcatgcttctatgatgtgccacgtaatgttctaagcttgtagatatatcagtgaacaagagagataaaatacgtactctgatagaagttagaggtttatagggataataatggtacttatttcataaggttgttgtgaggattaaattataaaatgtatgaagcccccttagaacactgcctggaatgttgtagaagtttcaatgattataattgaggcagcgttccttccgcgggggcactagctgcggggagtctgttccttcagagccctgattcagcgatggatgaataaacgtacactgacacacagatattctgctctgccagtcccgctgagggtcccagtcgcttacaggcttcctgctgagccctgtaaacagttgccactgggccctgatcagctagcgaggctctcgccatttattcagtgactaattaacaaaagttgtgagtaaacaccactagaaggtaaggatcaaaggccaggttccgaggcctaaagcaaacatcatttgcaggtaataaacttctgccgacccccgagtaggaggcagtaaagtacccgcggtaggacaaaggtcagtcttaagccaatataagtaagcatgttagtaagagcaacttcccacattcctttgtacttgcaccctaatctttctggctcctgcaaggagagcttggctgccttcagccaagcaatctgaagctatgcaaactctcagatcttccaagagagtttttggctattactataactatcttaatatttttcccaccagcctgattgaaccccaacctataatcacaattattataagatgattatactctgatgagaacacttgatcaaagtacagtgatgaagaataggaaagttcttgacacatagggatgaaaataatggaagcttatcatgatccatccaattcaacacatattgattgagagcctatcatatatcagatagtgttctaggagcttgaaatacagaaatgatcaaaaagaaggaactcagaagttgtcagaacatgtttcttacctggtgtatgaggtccctattctctctctaatagtccctgcttctgtgagcttaaccaccatttcaagtgatcaaatgtcaggtcatcttcattaatgattattgttaaggatctctgtgaaaatagattaactttcaggaatcaaatataagtgactctcaaaggcgaaagacatcccactggcattcagattaaaaacttaataaactggaaaactataaaatgtgtaaatgaggttaaaagtatttaaataacaatgaatatttttctaccttaatattaaagttaataaaattgatagtaaaattcttttctctcagttgtcattttgtgtcaacacaatttatgacttgacccaagctccttgtgtgcccatagaaaaacctggccactctactgttttaagaaataacgctgtagtcatccagaagtcttacctctctaaattcatctgcagaaagtcatatactttacaccacacaactttctcccattctagtctcattttttcaagagctgccaaatctaaaggaaggataattactcacaaactataaacgaattcagtaaataatcatagaaaaatgctcagattcactaatgagcaaataaattcaaattaaaacaatgaggcatgagatatgtatttaatctaataaattagccaaacaaatcctgtttttataaagataattcccaatactatcaagaaagcaggaaaattggtaatcccatattgctgatgtcagtgttaattggcctttaaggaataaatctaacaaagtgtgtcacatgctattaattttttcatatgttttgaacaagtaactcaatttgttgtgttgtatcctaattttgaacagaagcatatgcatgaagatgttattaacaccattatgtgtattaataagaacagaaataatttaaatgtcaaacaataagaaaactcttaattctagcacattatttaagcattaaaatgtttttaaatatttttctttttaatatttaaattattttaatattaaaaatatttttcttctttttattgtttttttattgaggtaaaaaataccatctttgctattgttttcttttttctttttgagacagagtctcgctgtatcacccaggctggagtgcagtggcgggatctcagctcactgcaacctccgcctcctgggttcaagcgattctcctgcctcagcctcccgactagctgggactataggcacctgccaccacgcctggctaattttttgtatctttagtagagatggggtttcactgtgttggccaggatggtcttgatttcctgaccttggcctcccaaagtgctgggattacaggcgtcagccaccaagcccggcccaatctttactatttttatgtgtacaattcagtggtaataaatacatttatatccttcttccttttctcttatattactccattttaccttcctggcctccgataaccaccagtctactgtcaatcttcatgagatccactttttttagttctcacataggagtgagaatatgcaatgtttgcctttttgtgtttggcttatttcacttaccataataggctccagttccatccacattgctgaaaaagacaggatttcatgctttgttatggctgaattatatttcattgtatatgtacatatacaatgaaatatatatgtacatatacaatgaaatatatatgtgtgtatatatattacattttctttatccattcatctactgatgggcacttaggttgattccatattttggctattgtgaatagtgatttgggtattgtgaatatcataatatttgggttttatgaatagtgctgcaataaacatggaagtgcaaatatctctttgatatactgattacctttctctcagatatatacaccgtagtagaattgctagacaatatgaaagttctacttgtaggtttttgaggagattccataatgtcctccaagtggctatactaatttacattcccacttagcgtatgaaggttgccctttctccacatccttgccaacatctgttgttgcctgtctttttgatacaagccattttaactggggtgagatatctcattgtggttttgatttgcatatctctgatgattgaagatgatgagcattttttcatacacctgttggccatttgtatgtcttctttagggaaatgtctattgagatcctttgcctatttttaatttgattatttgggtttttccattattgagttgttcgagctccttatatattatatattctggttattaatcccctttcagatggatagtttgcaaatattttctcctattctgcaggttgtctattcagttttattgattgtttcctttgtagttcagaagctttttagctttatgtaatcccatttgtctattttttcttggtcgcctgtgcttttgaggtcttacacaaaaaaatcttttctcaaataaatgtcctagagcattttcctaaagttttcttctagtagtttcatagtttctggtcttagattcaagtttttaatccattttgatttaatttttatgtagggtaagagatagggatctagctttattcttctacatatagatagttacccagttttcccagcaccacttattgaaaagactgttctttcctcattgtaagtttttggtgcctaagttgaagataagcaggctgtaagtgcatggatttatatctggattctctattctgttccattggtccctgtgtctatttttatgtgagtaccatgctgtttttattactatagctttagaatgaattttgaagtcaggtagtatgaggcgaccaactttgttaattttgcacaggattgctttggctattaagggtctttagtggttccatataaactttagaattttttctatttctgtgcagaatgtcattggtattttgataggattgcattgaatatgtaaattactttgggtggtattgtcatcttatcaatattaattgttccaatccatgagcatagactatctttctgtttttttggtgtcctcttcaatttcttttatcagtattttgtagttttccttgtataggtcttttacttctttggttagattggttcctaagcattttatattttttgtagctattgtcaatggaattactttcatgatttctttttcagattgtttgctgttgccatatataaatgctactgatttttatatgttgattttgtatcctgaaactactgaattcttttatcagttctaacagttttttgatggagtctttcgatttttctaaatgtaagagtgtgttttttgctaacaaagctaattagacttcctcctttccaatttgaatgttctttatttctttctctttcccaattgttctggccaggacttccagtattgtgttgaataaaatcagtgaaagtgggaatccttgtcttgttccaagtctttagaggataggtcttccatgtttctccattcagtgcagtgttagtcatgggtttgtcttagatggcctttattattttgtgatatgttcctactgtacacattttgataagggttttttaataaagggatgctgaattttattaaatgcttttgaggcatctgttgaaataatcatatggttttgttcattctgttgatgtgatgtaacacatttattaatttgcatatgttgaaacattgtcttacccctaggatgaatttcacttgatcatggtgaacgatctttttagtgttgttgcatttggtttgctggtattttgctggggatttttgcagttatgttcttcagcgatattggcctgtagttttattttcttgtagcatccttgtctggttttggtattaggctaatgctggtcttgtagaatgacttgggaagtattccctcctcttcaaatttttgtaagagtttgaataggattgggctgggcacagtggctcctgcctgtaatcccagcactttgggaggccgaggcgggcggatcacgaggtcaggagatcgagaccatcctggctaacatggtgaaaccttgtttctactaaaaatacaaaaatttagccaggcatggtggtatgcacctgtactcccagctacttgggaggctgaggcaggagaatcacttgaacccaagaggtggaggttgtagtaagccgagatcgcaccactgcactccagcctgggctacagagcaagactccatctccaaaaaaaaaaaaaaaagagtttgagagtttgagtaggattgatattagttcttctttaaatatatggtataattcaacagggaatccatcagattctgggcttttatttgatgggagactctttattacagctttgatctaattactcattttttgtttgttttgttaaggtttcctatttcctggtgattcaatcttggtagattgtatgtgtccaggattttatccatttcttctagttttttcattgtgttggcatgtagttgttcatgataatctgtaatgattctttgtatttctgaggttctcagtttctgtgtctccttttatttgctgattttatttatttgcgtcttctctcttttattcttagtctagctaaaggtttgttgattttctttatcttttttaaaaaacaacctttgctttgttgatcctttacattttttagtcttaatttcatttatttctgctctgatcttttattattttttccttctagtaatttaggattttatttatttttgcttttctaatttcttgagatgccttgttaggttgttaatttgaagtctttctacttttttgatataagcatttattgctataaaccttcctcttagtactgctttagctgtattccatagagtttggcattttgcatttttatttcaatcaaaattttttaaaatttccttcttaattttattgacccattggtcattcaaaaacatggttttttaaatttccatttgtttgtgaattttccagggttcatcttgttttttatttctagttgtatttcatatttttcagagaaaatacttgatattatttctagttttcagaatttgcacaggcttgttttgtggctcaagatatggtctatcctggaaaatgttctatattcagtgaaaaaaatgcatgttccacagaacctagtgaaatgttctgtaaatatcaattagtcctattagatctagtgtgtagtttctctccactgtttccttgttgattttgtgtctggatgatctgtctgttactgagaatgggatgttaacatccctgactattattgtattgcattctatctcttcctttaggtctattcatgattgcttcaagtatttaggagctctgtattgggtacataaatatttatacttatatcctcttattgaattggctcatttatcattttatagtgatcttccttgtcttttttcacagtctgtgttgtgtagtctatttcatataatgtcaatatagttattcctgctcttttttgctttccagttgcacagaataccttttccatcctctctagttatgtgtgtctttacaggtaaagtggggtttttgagggcagaatataattgagtcatttctttatccattcagccactctatgccttttagttggagagttgaaaccattcacatttagcgttattattgataagaacttaccactgctgtttcgttgcttgttttttggtggttttgagattcctctcttcttttcttcctttcttactgtcttccttttggcttaaattattgtctctgatagtatgttttaatttattgctttttatttgtagtgaatcaattataactttttgtgctgtggttatcatgagatttccaaagtatattttattgatgaaacaagttactttaaagggatggtgacttatcttagaacacaaataaaagaatagacacaaacaaaggcaaaaaaacccacaaacacaattctacactttatctccatctgccttacattttgacttttagttgtctcaatttacatattttaattacctatctcttaacaggttgccatgctatttttgtttttgataaatttttctttgggattttatactagagttataggtggatggcacaccacaaatgcatactctgagtttgaatactctgagtttgttcatgtacttaattttgcaccttagtgcttttgtttttcagtttgaagaactccctttagcatttcttgcaaaacgggtctgttggtggtgaattctctcaggctttgtttgtctgtgaaagacttttctctatcctcaaattagaatgagaattctgctgaatacatttctgggtggcagttttttctttgaacactttgaaaatattgttctattccccttgagccagtatggtttctcttgagaagcctgttgccaaactaattgtagctcccttatatattacttgattatttcttgctgcttttaggatcttctctttgcccttgacttttgaggatttgattatctaatgccttggggtatttgatatggtttggctgtgtccctgccgaaatctcgtcttgaattgtagctcccataatccctatgggggtatttgatatggtttggctgtgtccctgcccaaatctcgtcttgaattgtagctcccataatccctatgtatggtgagaatgacctagtgggaggtaattgaatcatgagggtgggttgttcccatgctgttctcatgatagtgaataagtctcataaggtctgatggttttataaagggcagttcccctgtacatgctctcttgcctgctgccatgtaagatgtgcctttgctcctccttcgccttccgccatgattgtgaggcctccccagccatgtggaactgtgatttcaaaaacttctttttctttataaattacccagtcccaggtatgtatttattcacagtataaaaatggactaatacagtaaattggtaccaggagtggggtactcctataaggatacctgaaaatgtggaagcgacttagaaactgggtaacaggcagaggttggaaaagtttggagggctcagaagaagacaggaagatgtgggaagtttggaacttcctagagacttgttgaatagctttgaccaaaatgttgatagtgatatggacaataaagtccagactcatcagatgaagatgaggaacttgttgggaactggagtaaaggtcactcttgctatgcaaagatactggtgacattttgcctctgccttcgagatctgtggaactttgaacttcagagagattagggtatctggtggaagaaatttctaagcagcattgtgttcaagaggaggcagacgataaaagtttgaaaattttgcagcctgctgatgcagtagaaaagaaaaacccattttctggggagcaattcaagtcagctgcagaaatttgcataagtaacaaggttcaaaatgctaatcaccaagacaatggggaaaatatctccagggcatgtcagagaccttcactgcagccccaggcccagtggcctaggagggaatgggtaaacagacctgttccaaatgggagaaattggccaaaacaaaggggttacaggccccatacaaatctgaaatccaatagggcagtcattaaacctcaaagctccaaaataatctcctttgactccatgtctcacatccaggtcacactgccgcaagaggtgggtttttacagtcttgagaagctctgcccctgtggctttgcaggatacagagcacctcctggttgctttcatgggctggtgttgagtgtctacagcttttccaggtgcatggtgcaagctgtcaatggatcacaggcccagaggtctaggaggtaaaaatggtttcctgggccaggtccagggtccctctactgtgtgcagccaggacttggtgccctgcatcccagccgctccagccatggctaaaacgggccaaggtacagctcaggccatagcttcagagggtgcaatccccaagccttggcagcttccgcatggtgtttgtcctgcaggtacacagaagtcaagtattaaggtttgggaacctctgactagatttcaaaggcaggggtgtgctgcagggttgtagcccttatggagagcctctgctatggcagtgcagaagggaaatgtggggttggagcacccacacagagtccccactgtggcactgcctagcggagctatgagaagaaggccaccatcctccagaccccagaatagtagatccattgacagcttgcactatgcacctggaaaagctgcagacactcaacaccagcccatgaaagcaaccaggaggtgctctgtaccctgcaaagccacaggggcagagctgctaaagaccgtaaaaacccacctcttgcagcagcgtgacctggatgtgagacatggactcaaaggagattattttggaactttgaggtttaatgactgccctattggatttcagatttgtatggggcctgtaacccctttgttttgaccaatttctctcatttggaacaggtgtgtttacccattgcctatacccccattgtatctaggaagtaactaacttgcttttgattttataggctcgtaggcagaagggacttgccttgtctctgatgagaacttggactgtgggcttttgagttaacgctaaaatgatttaagactttgggggactgttaggaaggcatgattggttttgacatgtaaggacatgagatttgggaggggcccagggtggaatgatatggtttggctatgtctgcttccaaatctcatcttgaattgtagctcccataatttccattgttgtgagagggacccagtggaaggtaattgaatcatgggggtgggttatcaggggtaccagccccaatatttcaacataggtacttttctattttccctaagtgtcggccggtctgagaaataaagagaaacagtacaaaagagagaaattttacagctgggtctccaggggtgacatcacatgtcggcaggttccgtgatgccccttgagccacaaaaccagcaagtttttattagggttttcaaaaggggagggagtgtacgaatagggtgtgggtcacagagatcacatgcttcaaaggcaataaaatatcacaagggcagagaggcagagtgagatcacaaggccagggtgaaactagaattactgatgaaggtccatgtcctgctgggcacacattgtcattgatgaacaggaaacagggtttgagagcagacaactggtctgactagaatttcacctggctggaatttcccaatcctagcaagctggggggcgctgcaggtgaccagcgtgtatttcatcccttatctacaactgcataagacagacactcccagagcgactattttagagacctccccctgagaatacaatattttcccagggctgttccttgctgagaaaaagaattcagtgatatttcccctattcgcttttgcgagaagagaaatatgactctattctgcccagccccacaggcaggcaggccttatggttatctcccttgttccctgaaaatggctgttatcctgttcttttcaaggtgcccagatttcacattgttaacacacatgctttacaaacaatttgtgcagataacgcaatcatcacagggtcctgaggtgacatacatcctcagcttatgaagatgacgggattaagagattaaagtaaagacaggcataggaaattataagagtattgattagggaagtgataaatgtccatgaaatcttcacaatttatgttcagagattgcagtaaagacaggtgtaagaaattataaaaatattaatttggggaactaataaatgtccttgaaatcttcacaatttatgttcttctgctgtggcttcagctggtccctccattcggggtccctgacttcccgcaatagtgggtctttccaagctgttcttctgagagtgtataagtcttaaaatatctgatggttttataaaggacaattcccctgcacatgctctctttcttaccactatctaagacgtgcctttgttactcctctttccaccatgattgtgaggcatccccagccatgtggaaatgtgagtccattaaacctctttttctttataaatttcacagtcttgggtatgtcttattatcagtataaaaaaggactaatactgtattcttatttaggttgaatctgttcggtgtttaagaactaactgtacctggatatttatatctttttcaagttttgaaacactttctgttatagtttctttgaataggctttctacccattgctcttgctcagctccctcttgaatggcaataattcttagatttggtcttttgaaataattttctatgtcttgcaggtggtctttattccttttcattctttttttttcctttttctcctctgaatttgtatttttaaatagcaggtctttgaactcactgattctttcctctgcttgcttcattccactgttaagagcctctaatgtgtttttcatctcagccaatatatttcatagttgcaagatttctgtttgtctttttattatttcaattttttgctaaatttctctgatcaatttctaaattgattttctatattatcttggagatcactgagtttccttaaaactgctgttttgaattcttgatcagaaaactcacaaattgccatctcatttgagtcagtcactggctttttgatttgaccttttggagagatcatggttttctgtttgctcttgtttcttgtgggtatacatctatgtctttgcactggagaattagttatttattccagttgtctctgtctaacttgttccagtttttattgaatacatttgcttagcaattctttactagtggattgctgcctccttttcagctctaggtgacaccttaagcctaggttcatctcagctctagtaaactgtcagaccactgcctgtcccaaattgggaaggtcccaaaagtattattctggcatcatgggaagcttggctaggggattataaagaggggacctggggaacatacctcctatagctgctcttagttagactctcctttggctgagttacagagcagagtttctgagctggagatggtagtcctgcctactttgtttgtttctgcctgtcctcagagatagttttcccttcaggcagtcatgatgctactcatgggttaaggcaaggacagttctcctgctggtgaacccaagaaaatggggaaatttgttgacaacctcaattttactttttccagtgtagaaaccatgagttgaagggagattttcctcacaggtggtgcctgggcagaattagttggaggggtgtcatccttgtgaatgtcagttgtccatcatctgctcagtttttccacttctccgcatccccagaaactggctcatcctcatacttgagctctgggttgttgctgttgaagaactcagcgctgtatatttggactttttgttgttgctgttggtgtttgttgtaatggggaatgaagccagcttgtctctacaccaccattttggataaaaatatatttttttaataatctacttcccctatactctactcaaaaggtatgtgagatagggatgtcatgctaaatgatttttaatgcagaatacatgattatatacaaaatatattttaaaacgtgtcaatgaaaaaagtcaaactctgtaaaatatttgaagagatttattctgagtcaagtatgagtgaccatggcccatgacacagcccttaggagatcctgagaacacgtgcccaaggtggttggggcacagcttggttttatacattttaggcatacatgagacaatgagccatctatcagatacatttaagatatactttggtttggtccagaaaggtgagacaactcaaagcaggtgggtcgggggagtggtgcttccaggctacaggcagatttaaaaattttctgattggaaatttgttgaaagagttatcagtagaaataaatgtctgggttatgataagaggttgtagagaccaaagttttaccatgcagatgaagcctccaggtagcaggcttcagggagaataaattgtaaatgtttcttatcaaacttaaagtctgtgttaatgttaatgctgaacggtatagtgaggcatatcccacccccacttccatcatggcttgaaacagtgtttcaggttaaattttagaatgacctggccaaggaggaagtccatttagatggttggagggccttagaattttatttttggtttacacatgtactggaataatatgtagcccatattgtatataccagtgagattgtggatgactatttttctttgccatttttattttgtggaaaattcttatgtaactttctaaggtatgttagaactcactgtgaaacctcaggtcctacttcttgtcataaggacaggaagttcatgctcatttgtttgcagggtctcatcagggtgtaggaagatagggagaaaagctgataccgagtagtaattgttaccacttgttttgtttggttgattggtaggttagtgggtgggttttattttttagcctattaaataaaagccttaaaattagaaaatttggcaagagcttatctcaatcattaaaccagaataattccagaataatttttccaaaactaatgtatttacatcaagtttggaggaaaacataaaaactcttgaaaattgtattgatagtacccaggatgtaagaacaatccattttagatctgccatctcagcaagcctctcttcaaaataaaaatctctcaattctcagcattttattacatactaagaattttctttagatttggctgagaaacaacatagagtcataagttatagaatatagctgtagctgaaaaaaagaaatgcttgttataataagcctctcagtgggggaaaagttggagacaaaagggacagttagaaataagtaaaaacctatgaaaaagagcagagctgttcaagaaatgatacattaaaaaaaaaaacttacaaggatggctacatgttttaattttcagaggcaccatatcttactgataataaaagccaaagcctttgtagggacttcaaaaccctcctggatccagctcccatttattctctgacctcatctcgtaccgtgttttctgctccctggatattcctccatcgttctctcaaggcctttgtacttgttctattttattggcatactcttctccccacgtgatttataccttcacttccacattgaccaagaaccattcagaaaaacagacaccacaccaggaatttcaacagaagaaatttaatataagaacttaattacacattaatctgtggcacagaagtcagggtagtggttacccttggaagagagcctaagaggatgctggaaatgttttatttcttggcttgggtttgcagcatggctgccttcactttgtgaaaagtcatcgtgttgttcacagtctatcctcattattcactgactctggaataatgaatttacctaattgctaagatttattggtaacccccaaatcagtactcactgagctttgtggccatttgcagacatacacattgaggggaaaaatttgagtcaccaagacgcatgctttcctagctgtggtcagacaaagcaactctctcatattgtgtcagctctacttgtttcagctctcatattgtaaacaagagtcttttttgtggtctacttaatactacatggtgtgtgggattttttttcttttttgcattttcatgctttctggtggtgatttcactgtttaaaattacccacaagaatagtgctgaagtgttacctagtgtgtgtaggtgtaagactgtgatgtggctaatgaagaaaattcatgtgttagcttcattcaggtgtgagttaccgtgctattggcagtaaatgcaatgttaatgaatcaagcgtatattttaaatgaagtatctttaaacagaaacacacatgaaataagattatgtgttgaatggccaattaaagtgtgaccagaggcttgcaggagcctacccctttaatgaaatgtaagtgcaaaaattacagttgatttgcattatttgtgatagttatattgtataaaatcaccgtgaacactgaattagtgaatgttgaatcattgaccttaaaatattgaaataacccagataatggctgcaagaagccaatgggttttgctcctccttgggctaaagaaaaatgaaaataatttagggtcatttgaacctaacagtttgaaaggttctcataccttgggggtgatgccacctggtgctttgggtatctctgaagggatattatgaagctgcttaagaagccggaagctggaaccaattgctgttggggcattgtcattgccgggacaatctcaacagaaacaccaagcaaaggagaagaaaggatttcctcttcctttgtgccttccagtcttcctctcatatccttattggcaaaacctatctcaaagccaactggaaataaataatacatacacatacatttcatatatgtacatatacatatgtatacacacatataatgtactttacagagttaaagtctagcattacatagaagaatatatttagatccgagagataatagcttaataactatcctagtccatgctttaggcttctcagcatccatatacactctgctacatatatttattatatagaagaatatatatagatataagaggtaatattaataactattctagtccacactttaggcttctcagcatccatgtacaccctgctacatatatttaaacttatagataacaagtgaagacagtttcactctccgcctaagaatagaagacatcaagttccaacatcatagtcatctttgagaagtcactgtatccaactctgagaaatgactattcctctaaatcacacaaatcccacctgaacactctgtaacctaaagaatgaagtttagctgacaatcctatataaaacaatagagaaaaataagaacgaataaaaatattaattattaataaaaataagaaaaaacatatactacactgcatacatacaacaaaaaagaaaatatgactaaaacatctctcagttctctagtttgtcacaaaaccatttgatacatgtaatttctttcttctaccaccccatcacatgtttcttttgcccagtgttcagctggttaggatcctttagataacgggatagttcaaaactttattcttaaagggtaagaatacctggtgaacctgtttgtttggggtttctcttggtagctttacattttcattaaactttactattaaacatgaagtactatgacgcaccacagatgatctcttgtatccaaaacatagtactccctacctgcaatatgtcacagcaatataattttcctgaatagtccaaaccaatcaccccagcctgtaaagtacctctcttctttgcctactagatctgtggcaagagataccaaagtggctatgtgtaatctgtttcatactgaacacaattattgtgtcttcaagtaaagatatttcttctttgggaaccaagatctgaaaactaacagagcacaaagttacagggataggtaaggaaaaagttggcaagcaggtaatgagaagggccgctaccatgaaaacaccttattttcagaacccatgtattctggctatgtaagagactacctataaaatagcatgtgtccaaacctttagccatctttcagtccagataaagcgaacaacaaactatactgcttaaaatctgctgacaggatttcccttcaccaccatttttctaggacatcatttttttggaagccttaatactatagcagtccacttctagttggtgctaatgtattatgcagagctatcagcagacctgagtctaggtaagaaccagtacgagctcggggtcacctccttacacagtttactgcttttacttaatgatcgatagctgttatgcatgccaaacttgtgatgtgataggtcaaataatcccaattaatcatgctcagctcaggttacatggtgatttgacgtcccattgttcaacactcaatctttaagaagcctcaatagcaagcaaagaagtagttctccaaaggaaaatagttatatgaaaagagcctattgctttcctccatgggatgtgctgtaattctatggaggcttgccaggagttccatacagcattcttacatgtgtcagacctttaaatatcatgagatctacttgatcagaagacccaagtaaaagagtagcttacaccacagcctagagttgttgcagagccttttatttttaccccctcaggctccactaaaaactggcaactgcattggttcctcagaaaatgggttagaatatcatatcctaatatagtatatgttgcctcaaaaatccaaagaggttcaccaagcattatgccttgtttttgggggtagatgtttaagatgcttttaactgtttttcactgtgaagatgatattgtgacatactgcagatcgttggacaccctctggaaactttaccaagaagatgccctttgaattctggggactttatcttccaccctcatgtgctttactaagatacataaagcaatttcaaggtcctggctcatcaaaaaaattatcatgatggcatcagtgtagtggaccagtatgatgctcagtgtgatatccagatgatgaagatctgtctaacagagaacataactgtgcagatgtgctatcatccttatgagaaaagaaatggcttctcgatgtccttacaaacttatatttaaaaagtatttgccagataaataactgtatatcagatatcaaagattgtgttgacatgattaaatttatgataatctattgtcatcctccaagatccatctatcttctgcacaggcaaaacagataagttaaatgagaatgtgatagaattcatcacctttcatacttcagatcttttaagtggcattcatcttagcggttccagagggatatcatattgcttttgaattattaccctcctctagaggggaaactccaagagttctacttagcccttcctgtaatcatgatcctgaattcacaggtctgaaagtcaatgtagagattctatcagttgccaagtgcctatctcaattatgcattcagaagttgaatctgcatccccactgaactgactgttagacaaaggttaacattccatttaccatctgacttctgtaagcatccactttgattgatgggtataatggcattttgggtccccagaaattaggatcactttagagccagtgactggatatcagtaataaattccctttcctaagtgcttagctatcataacacatggctacaaatccattttggaaaaaaacttggagaaagtactagcaatacatacttgtggcaatgttgcagttatttttcaagggaaactggaacccccttaaatcaaggagatacatgtctgtgtactgatgtaggtctagaaaacaagttagagactgcaactctctattgtgatgactcaaatcagggttctggtcaccagatctagaagattttctataaataaagtaataagttagtaggctgcccatttatttcattactaaggacaatttgtcacttccccaaatttctgggtgtcaacactttgatttccactttatcctttgtgcctattgtggtgactgcctccaccttttctctctcgtggtgaaagacttatctctcagttggcctctgccattctaggatcccatcatcactgttgataccaagaagtcaatctcatagtgccatttcaaacaagacacaaaaggatagattttaagagtgcgcgtgcgtgtgtgtgtgtgtgtgtgtgtgtgtgtgtgtatttcagatcataatatccaccaattttgtattttctgtttcatgcaacatttattagggaacattttcccttgccattcaatattgtttcatgttatttgattttagtataataatcaatcatgtttatataccaaagattaagagcatacttggaggtgatcattgaagtaactaggcttgaaaggatatgagaagaaattaaatttagcaagaattagccttaaatgagaaaaaagaacacccttttttctctcaaacaatagggaaagctgggataaaagaacagcaagaaattctataatgtaaagatagtagactgtaaagtttctctgttaattaaaaaaagaagataaagaggatatggtaagaggatttatacaagcattgaaaagcaggttcaagttttgttcttgctgctgtgggatatagagaaatgaagaaactggaaattcataaaattagagctcttattatgttatacattatgttattttagtggttattattactaggtgaaattgtagagattaaagaaaattattatcttttcaaaacatatatatatatatgtacacataacttttataattagaaaaataagccataaaattgtagaggcaaaaacacagaatcatctgaccagcagtgtgaagaatgaattggaggtaaactactgtggcaggagttacagaagcttgctaaggtcaatatacttgcctgagtaagaaactataaggtgagacattacagtgacttaaactaaggcagaagtggtcacaatgggaagaatgggattcatatgtaagagatagattcaaaattaaagttgacagattggagtcgtggcaggagattggagaggggatgagagagtggaaggagaggttttggacttgagcatccggttgaataaccatacttttcagtaaattattcaaatataagatgaaaaatacaacttaggcgagggagctgtggatgtctgagggatttcaatgttaagatcatccacagtcaatgtgagctatggagtgtggcagagtcaaaatttcatgggttttggactaagacattactggttttaaatgttattactgctgcttaccaatcatgttacaaaacctatgggccaaatacttctctcagctgaaatttctcatattaaaatcaagataataaaattataatgataataataacatctgccttatagtattgcttgaggaataagtgcctagtaaacctgcaatttaattgtaaaattattataggcaattattattattattgcttgctgtgttttgttaggcaggttagtcaatttctataagcctcaattttctgtaaaatgaggataataaaaatctaccacacaaccttaaagtgagcgttaagtgagatactgcatagtctaatgcctggtgtatagtagttgttaacaacaatggtaccaatttgtttttattatttgtcatcatcattcctattataatgtgttcaaacatattagtaaccaaagtatgaaaattaaaataaacactgaaatgttatcaagttcactgaattttttatattttaattggatatagccatttttatagtatctaagcctttttctcaatgtttctaagtctccatttttattaatttgtaaaaatttctctatattagcttttgtctataatagttaatattttgcagttcttagctaccttttatttttgaattttctttatgatttttagtggacataatgtgggtttataaaatattcttttgtgattaaaaaattcaataaattaggtataaaaggaatgctccttaatataacagaggccatatatggcaaacccacagctaacatcatacttaatggtgaaaatgtgaaggcttttcctctaaggtcaaaaacaagacaagaacgcccattttcaccacttctgttcaacatagtactataaattataactagagcaattaagcaagagaatgaaataaaagccatcaaaataggaaaggatgaagtaaaattgtttctatttgctgacatgatcttctatatagaaaatcctaaagactccacctaactcgaaagtgctgttaaaactgataaattcagtaaagttgcaggatacaaaattaatattatgtttatatactaacaacaatctgtcaaagaaaaaataagaaaaaagtccacttacaataccatcaagtagaataaaatagttatgagcaaatttaactaagtaatttaaccccaaaatgcagttagtgaaagcaaaaacgagataggattgcctcaaacaaaaaccttctacaaagcaaaggaaacaacagagtgaagagacaacccatagatggggagaaaatgtttgcaaatcatatattggataaggggttattattcaaaatatacaggaaactcaaactactcaatgacaagaaaacaaataaccccattaaaaatgggcaaagaacttgaatagacagttcccaaaagaagacatacaaatgagatgaatagataaagtggaaaaatgttcaagatagctaattatcaaaaaaatacaaattaaaactataagaagatatcacctcacatctgtcagactggctattatcaaaaagatgaaaggtaaatgttgaccaggatttgaagaaaagggaacacttttacactgttgatggtattgtaaattagtatagtcattttgaaaaacattatggaagttcctgaaaaaaaactaaataaagaattaccatatgatccagcaatctcattactggatatataccaaaggaattgaaatcagtatgggaaagagatgtatgcacccccatgttcattgcaacattattcaccatagctaagatatggaaaaacccaaatatccatcaaatgattaactttttttttaatgtggcatatatacacaatggaattgtgctattcagcttcaaaaaaaaaaaaagccacaggaaaatacatgtcatcatttgtgacaactagatgaacccagaagacattatgttaagctaaataagccaggcacagagagacaatcactatataagctcactgacacagttattgctaacaatgttgtcaataggttcttggaaactgcaacttttaagtgaaacaacatgtaacaaaaccaattttactatagattaattgatataagcaagacttaggttaagcttcaaaagaaagaccaaaacacttataatattaagaattaaaataaatgtgaactatatatacatttaagaaagattaataaaaaacaagtaagataattattacctgtttattccagttcagggatgagggtggacggagcctctcccagcagctcagggcacagggcgggacctaaccttgggcaggaggccattccatcgcagtacgcactcacacacacacccacactcagactgggacaatttagacccaccaattaaccgaatgttcacatctttggatatgggaggaaacaagagtacttgaagaaaacccacacagacatggagataacatgcaaactcactccacgcagacagacagtggccccagtcaagaatatattttttttttctctcatcaacattataatgaaacaacatggaaaaaaaatgctatttcagggcctgctgtatgtggaatctaaaaatgttgaacttacagaagttgagagtggaatggtggttaccagaggctggggttacgggtagatacagtaaggggaaaagttggtcaacacatacaaagttacgcttaggaggatgaggtctggaggtctggtgacctatcgcacagcaggagggctacagttaataataatgtatatttcaaaatagctaaaagagaggattttaaatgttctcaccacaaagaaatggtagatattcgaagtgatggatatgctaattagccagatttgatcattccataatgtatacaggtattgtactgcatgcatatacacatattttcttttgttgttgttgttgttgttgttgttgttgttgttgttgttgttgtttaagacaaggtctactctgttgcccaggcttgagtgcagtggcatgatcttggctcactgcagtctctatattccaggctgaatcggtcttgccactttagcctcccaagtagctgggacataggcatttgtcaccaggctaatttttgttgttgttgttgtttgttttttttttgatagagaagaagtttcaccatgttatccaggctggtctcaaactatacaattattatttgtcaattaaaaatttaaaaagataaccacaaaaaaggtaatcatgtatgtcactgtttttctttgagaccttctattatgtttatgcttggtctatcctccatacctacgatatccttatacacccctaatcttgatagtctttacaatttaattatcagctataatatttaaaccatgtgaactttgttgcattatgccaggtgatatttttcacttaaaattttttcagctaaccaattttctcaataccgtttgttttcaaaacatccattcctctctccatttatgtgtgaaggttcttttataaattactaagtttttatatgagaatgtatttctgagcattcaatttggttttcacaattctacaaatgacacacactgtttttaaaattactacattttaagtggctgggaggttaatcccatgtccctaagccccccaaatccctctttttaaactttccttagataatattggctgtgtttattttgaaattaaatcttcaatcatattattaaggtctagggtgatatctaattcccaatttcatacttgatagctttacagctcttaatttgaaaagaattagcatcttaatattattcaatctttccttccaggaacatgatatatttttccatgtcttctataattctcacaatatttctgatatttactctttgtagactcaaccttttaattaggtcattccttagtatggttttgttattttgtgaataaggtctagcttttttcaactatatccttaaatagttattgctatccttcagaagaaacgcttctagttttcttattgatcagtctattgaaattatgtctgcactactaaatgatttagttagtgttccctgattcttgtgcattttgataatttcacaatcttttaaaaatttataacaagagttaaaattttatatctgctataggtcttcagatttctggtacagtatgacattaagtaatacttctgtatatttgtctccagttcagggttgcgggtggatagagcctcaattttgagtttgtacttcaataacacaacttcaacaaagttttacagtgaaagacatatttttcaaggaaaaaatgtgaagcaacattcaaaataatacttattaagttttgtggttcacaaaggaagtcttctatctaatcaagattccttatttctcttaaatcaacgaaactttcctttgctcagctacacacaaatgaatcagaggcaggattcgtacctgccacttcaaatgatgccaacattattgtccagagtgattgtcatgacctaccaggaggtactctattcctcctaggagccaaatcccacacaacaaccttcaagactcaactcctctaggaaaatgctctcatgtcaggatggctttattctgtcatttccttcactcttgcaaatctgcaactcctcccttgacgttcctttgccttttcccatttataatataatactctcaaatattttctttttatacattgagaatcataatagacattgttataattttgcttcaaggtcaaacatattttggaaaactcaaaagaagaaggaatatctattgtattttacccatatttttgctctttcctttgttcttttttcattatgttccaaaattccttcttttttcatttcttttgtttagagtacttcctttagtcattttcttagggtaagtctgctggcaacacattcttttagttgactctggagcctcaatgttatctaagtagtccaggttctaggaatgtatctccaaaaaaggagtcctatttcaattataaatcttatatgtgggttgtgaagtggtgagttgtgatatcagaactgaaactacccagttctttcaaagcatcctacataataaagggctattgttgaggcatatgtggtttgtggtacctgattctatactgggattttaccttttacgcatatggaagtgatagaaacaaaattagcacagcacttcactgagaatgaaacaggagagtgagaaaacattactaacacacttttcaaaggctgttgagactttagtcttttcagtattactaaaattataaaaaaaagaattgtgattttaactgtaggtgtttagatcaaagatcaaatggagttaaggctcaaagttaaatgtttatattgaggtggtgggtaaccatggccttaagaagtgctggggaaaaaatatcagcacatcttaataggacaaactattgatcttaaaaatatcaccaactatttcactaatctttctctgtcattgtgtgagatgctacaaaggaaaaaaatgaatgcagagctagacactccttagaatccttccatcctatctgaattgcaaagaaaggcagtgaaaatttcaggaagtgatgccacaagaagggtgatgttcctgagccttttgaagtcacaaaaacagtgtaggctggatcctcattttcagacttcacagcacagcatatgcccaattgacagcctctgggcacatccacaagacacaaaagccagtgttctgtttaatgcactgtctagaatatctggtgtttcttgaaagactgcacaaagcagctagaacaagtaatggcagcacctctagtctgagcagttctgtctaccaactttgctaacgactgtctctttggctcattaaattattctgtctgagtttcactgggaaggtacaaagtcatacgtgcttgtacttctcatgaccctgcaagaactctttcattaaaaaatcaaggtggaaaaccagcattattagattaatagactatgcagtggccctaagaggaataagtaattatgttaagtaatccatatcaacttaaacttaaaaaaaaaaaaaaaagcccacaagtgggaacgtgccaaaaccctacaagtgagaacttgccaaaaaccctattgtgaatggtacaaataataaatcaatttttggtaagcttgtttaatcaccatttgcttaaaaaagtaatatatattaattattttctgtcctgttgtgagaacaactaattatcaggaaattcaagaaggctgaatgcttgtgggctttttaaaataaaactaaatgttattataaatgtaatataacaaaaataaattaaaatgtgttaaaaatattcagcacacccaaacaatatggttagcattttggcatacttccttcattttttcccctgaagcaatatacatccaattttgcacttcaaatttacttgacattaaatagtaaatgttatctcacatagatacataaacccataataattatttataataactattatgtccatttagtaaatgaaacataagttgcttaattagttattctttaatttgtggtataaaggtttatattttttacaattatgtttttaaaatatttaatgcattacttcaagaatataatttcttccatatgttgaataatttgcttgaaaaatagtcccagaagtggaataactatgttcaacattatgaagattttaaaaaataatttgaatgtattgcataatttacttttgattactttttattataaaactgtgtatccatgctgattttaaaagttttgaaactctatgaactatgaaataagaaaatacttgcaatctcctagcccacaaatgaaattaatttattttgatagatataattttatttttttctgtgaagatatgtcttctttcaaaactgagatgatatactcaatttagtcatctacattctattattttcattatgatgaatattttcaatataatcaaaaaagtcttagaaatataatttaattactgattccacatgtgaattgatatggtttggccgtgttcccacccaaatctcaccttgaattgtaataatccccatgtatcaagggcagggccaggtagagataactgaatcatgggggcagtttcccccatactgttcttgtggtagtcagtaagtctcatgagatctgatggttctataaaggcaaaagctctcttgcctgctgccatggaagatgtgcctttgctcttcctttgccttctgccatgattgtgaagcccccacctcagccatgtggaactgtgagtctatcaaacctctttcctttataaattacccagtctcaggtaagtctttattagcagcatgagaacagactaaaacatgaatagagtacatttaatcacacccttatcattaaatatttaggttattttgaattattttcaaagtgttatgtaaaattatgtgatgaagtttttctcacataaatcttggacaatatcacttgacgaaaaagtcttaggcttcttaaactgaaaaatcacattttaagactattgcaagatttcccaatttattttttaaaaccattcgtttctaaagttgcaacacaatttgaaacagaaaaaaaaatgtgctgtcactatatggacttcctaaaatctttgataattattctttaaaattggatctatcatagaataaccacaattatataataatttgtcatcaaaataaaatatctagattagtttgctaggcagtttagtgtctggagaagctaagcaaaatattgtaagatttagtttgagccataatttttttaaaagaacaaaaggatgtttgcttggttcaaaaaaaaaatctgtggaagatttagtagaggcccttaactacaaagatgcccacgagcagctctgcagtgctaatgagaagggagacagagataggtataggagagaggagggaagaatagatttgggttgaatttagagattctttttattatgtgagcacattagaattttacacaaaagaaggaggaaaattatactttttacataaggatttaaatttaaggtatagaactctaacatttcaggcaacggttggtggaaatattttggaatattgtgtaggtcttcttatcactcaaactccttccatattcttgatattttaactgacagtcattatcaataactgtgaatcttccttttctattaatgtaagtagtatacacacatacatacatacagaaaaggaagagagacagaatataacatagattttgagccaggcatggtggctcacacctgtaatcctagcactttggaaggccaaggtggttggatcacctgaggtcaggagttcaagacaagcctggccaacatggtgaaaccccgtctctactaaaaatgcaaaaaattagccagatgtgatggtgcatgcctgtaatcccagctactgaggaggctgaggcaggagaatcacttgaacctgggaggtggaggttgcagtgagccgagatcgcaccattgcactccagcctaggcgacaagagaaaaactccatctcgaaaataaattaaaaaaaacagattttgatcttggtgctaaaatgaatatgcattataggttatcaaaagtatctcctatctaaactctaaaatacaaaattaagctatgtttttatggaatggatggtgttaatgattgttatagttagaattctttagcagttcttttgctaaatactaatgttggcccaactcttccacaatttagaatagaattatggattccatagtagcatccacaacaaaaactcaaggaacctcacttccaccaaaaaaaaaaaaaaagaaaatgaaaacagatcaaagctccttaatgaaggaaaggggagggactgtagagaatgaggaagatcttttgtggttcctaagctcctcagtccaactcttgtgtcatcgcaggacataaaaactaccaattgcccacccagattttataaaaagtaatgcttgatggggactgagcctgcactagagtccatttgtcctaacttacttactaatactatttttattccatcaggttaactttgagtcacagtacactggtcatttgcagattctactacatcattcagaatgattcaaggatttaaggattgaatcattcaaggattatcagtgaccacttagaagccataagataagagatagataaatgacagatatagatagatagatagatagatagatagatagataattgataaatagatgcttttacaaaatacaaacttcaattaaacttctaaattgcaaaaaaaaaaaaaaattcacttgccgaataccactcaatcaaagttttttgagaagtaaaatatatgactgtggtttttagaagaaaagtaaaaatgatgatgtatcacaaacatcagataaaggaatggaatccctgctgtttccatcagttgtctgtctcctaaagaaacaatattatccaagtaccttgcacactgctggttcacaagggtggaagcctggagaaccttttatcttggaattaacaaataacaaaactacagtctttcttatttttaaaatatagcctcaaattcatgataaaactccttgattcatttcactcatttatttgaaattaaaaacagatacaacatacaaaagcattgtatattttcagtcaaattttgcaggctttgggagattgcactatgacttttatttaaattaatttgtgttgactttagaaatatctattcttacaaggcatcttttaacttctactaatttttctgtggcatattcttcctgtgccttgaattcaccatattcattatattttcctcagtatccttatttaatgagtttaaaccacttagggatattacttcaaagtattaaatgatgagagatacagcatatagaagtctcccttcatttggtaccaacgtgaaagcaaaaggatttataatttagattctctaagcatttttttagctgtcaatgattattaggccttatactcatcaataaaaccaaagaggtagtaatcaatgatagtgagcaccagaattctggtagcttagcaatgcaagcgcttcagaagtaagttattatagccaactaattccaaagtttacaaagttgttgtaaagaaaattggcacttgaagtggactacagtgaaaacaatcacagaagttcatggtttaccaaaagttctagtaggttttagttgttgaaccttaaatatgcaattaaaaaaataatcatagaacaacactacttgaataactggtgatttgtccattgcaagcataagaaataagatgggggctgggcgctgtggctcacgcctgtaatcccagcattttaggaggctgaggcgggcagatcatttgaggtcaggagtttgagaccagcctgaccattatggtgaaacctcatctctaccaaaaatacaaaaaattagtggggcatggtgatgtacacctgcaatcccagctacttaggaggctgaagcaggagaatcgcttgaacccagaaggccgaagttgcagtgagccaagatcgcgtcactgcacactacagcccggcaacagcgtgtgactaaaaaaaaaaaaagaaagcagatgtgtctacagttggcagaagagtttgttttatacagattataaaatattatgagatttatgattataaagaaattaatgcctcttttaggacaaagacattgttgtatacctcctctaggaactaaaatataaggttgacttctctgtttccaagtgttttgcattaaagcaaataaagcaggtaagggtgaaataatacacccttatctggatataatgtgatatacaactgaccaacattaattttagaattatattttacaagttttttgaaagattacattgatcttttttaagatattgctagaaggcaagactttgttttacctgcattttatctgatgttcttttcttagcaaagatcctggagaggttctagtttcatcttttttcccattattaattggccctgtaactaagtaaaaaattatgaataataataaattgatagtgcttccattgattaagcatctggtgtatgccaggccttggcaaacctttgccctctgaaatacctaatgcacagtctgtgggctactcttcagataacagagaaaaaaataaagctacattttcctgggtcttgaggttttgcaagcattttctacattggaatagaaaattcgtgttcctgtttctctacttcactggtccttctcttaacaatctattttttagttaataaaattaaaattcagaaattaatgtactatggtactgcccaggctttaaagtttaacccaactgggttataggatttggtaacagccctgagagttaagacaggtgatattttttccattttactggtgaggaaactgaggcttagagggattataatatttacataaagtcatgcaataaggaaacattaaaatcagaacttgaactcctctgtctcaacttccagtctctattcctatacaaagtagaaacatcaattgaatgcaagatcatctttcaaaattatgcaaactccatgcaaatgaggacatccacgaactaattaggaaatatcaagtaacctgacacataaaatatgagaaacattccataaatattaattctggtgatctttcctacataaacaattgaatgtggtctaccttttcaaatggaaagtaaatgttgagatgttacgtcccatgtgtttttttctgtttatcttgtcattgtgatttatataatttttgataaatcataaaaatagaaaaaggtacagagaataattagcacaaaagcatatgttctaccatgctaaattaataattgtaagcattctgccgaagttctatagtggtgttttgggattagcaaataaacattacacagaaagttgaagcattgttttcctccatcctaaacacaaccccactgcagttttttccctctctctcaagaggtaaccagtatcataaagatggcatacacttctagtccatctttatgtgcacacaaccacctatgtacacataaacatctatatattcatgaaaagtatagagtattgtatacatgttttaattttaaataaaagacatttcactgaacttaatattatacaattttttgtatagtaattttcattcaggccaggtgcggtggctcatgcccataatcccagcattttgagaggccaaggcaggtggatcacctgaggtcaggagttggagactagcctggccaacatggcaaaaccctgcctctactaaaaacacaaaaaattacccaggcatggtggcgagcacctgtaatcccagctacttgggaggctgaggcaggagaattgcttgaacccaggaggcagaggtttcagtgatcagagatcacgcccctgcactccagcctgggtgacagagtgagactgtgtctctaaaaacaaaagaaaggatttcattcaatatcataattgagatatatccccatcagtatatctaaatttgttgctgaagtagctcctctttatctcactttttgtggtttaaagatattaaatgggatattccagaaataaacaattcataagttttaaattgcacaccactctgagtagcatgtcaaaatttcactttgtcctacccaggacatgaatcatcccttggtccagcatatccatgatgtaaacactacccatctattagtcacgtagcagccctctgagttatcagatcatagtatatataaggctcagaactatttgcagtttcaggcatccactgggatcttggaatgcattcccatgcgaggacaataaaagtcccaaggggggactattgtagtacaatgcattttatcagtccactcccttactaatagatatttaggcttttcctgattcttctctattagaaatataaccagttagtctaggaggttcaacttattgcagtaaaattaggtgtcactggtgtagctctgagccttcatctgcttcctctatttactttcttgcccacaaccacaagaagaggaagagggcattgtatgaaagcagagtgtccctgaactcacccacttaccaagcccctagcctagattcactcagaaattgcatctgtgcaggtaataggggagatgaattagaaattaccaatgttcactattagccaattctcctttgggtgcatggtggatgaaattctctgcccttttcaaggtaggtgtgaccatgttcatattctggccagtgagatggaagcagtcaaattctacaaactggaacaggcatcacaccgatcactctggcttattaccagtcagatccatgtgaagagttttatttcttcaggcctagtggtcccttgcaggatgcaatcatatatgtcataccactgatctttagttgaaaatgcctcttgtcacttgggtaagactgtagtcaacaatttcatccaccctttagggtctcctcccataggcagggggtgtgtgcagaatctcctccacctgactgtgtcctcactccgccatctcttcctgtagcactaaccatgaacattatgctgtctcccatgccagtatcccatactctcaggtacacaggaactagggaagtgactttcttaggatattacacagagaaggaatagtttttcctcataaatcctgcacctgcactctttgaaatatttatagtcttttttttttttttttttttttttttttttttttttttttttttttttgagacggagtctcgctctgtcgcccaggccggactgcggactgcagtggcgcaatctcggctcactgcaagctctgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaccacacctcttcttatgtcaacttggattgtgatgagagaatggggccagtcaaccacccagtgaactctgtaggtaggctgaacccgattactttggtttctcagaacctctgatgtgggccagttcctccttgtgggtctcagctttaggatcaccctgttatgtacaggaggctgctacaaaaggccttgaaaatatttccttgtagaaatgtgcactgaacatacctagaagtaaaagtcttgggttggaggtttagttaatggtcataattagtacaactattcctgaaatttttaaaaaatagacctactctgaaacaagtccccctggctcctttgctctcaccttcccaccttaccctgagatgcttgctctgctgtgatgacctcttttctgctaagcagagttgtttttcactcttaagaacattgatgccctgcttctctacaactgccccagaaataacatgccctggcctgcaacttcctagccacctccactgtcaataaatgaagcagagggtcaaggacactggtccctgctgacctgtgcccttcagccagctgcactcacactggagagtgtgagttctgtcttctaggaggaccctgatccctcgccccaccgactaccccccacaatgtgggtcctgaccagcaggggataggaggacctctcatgcctcgctagggcctttcgtgattggtggtgttggaggagcccacagaaatgagaaaattgacaaagtaacccgaacggttgcctaaatgcagtgaccaacataaggagccaatggattaaaaggataggaaagatgagagtaagaaaaagaggctcgatgaagagagaatagaaacagggagtcaattcctgattaggcaactttggagtgaacaagttctgaacaaggaaaaatctagggagagaataaatggggcctgcctagagaaactaagaataggccaaattatacaatgatgttgtcccttctatagcctgttcccataaatacttgcctttcaggaaaaaaaaattaggtggtacaagttgcagaatttacacctagacctcttttaaatctgagaaattattctaccactgttggttctgagtaaagaaaactttatggaggatgtatactactgtgtgtgcttcactagcaaacctaggaggaaatatttattataaaacacactttagggaccaatttaaagtaatcagtattatattaaaaatctaggatcagagtccagaaaactatagattgagtatgatttgggataagctactagagaagacatttcttttttcaatgtttatttgatgtctatatgtttgatatagtttggttctgtgtccccacccaaatctcatgtggatttgtgatccccatgtgttgaaggaggagtctcatgggaggtaactggattatggggatggattttccccatgctattctagtgatagtgaatgagttctcatgagatctgatggtttaaaagtgtgagagcttcgcccttgctctctttctctctctctctctctctctctctctttctctctctcctgctccactatggtaaaacgtacttgcttcccctttaccttctgccatgattgtaagtttcctgaggcctcctagtcatgcttcctgttaagcctgtagaactgtgagtaaattaaacctcttttcttcataaattacccagtctctggtagttcttcatagcagtgtgaaaacgaactaatacaatgttcttccactgttcccatttctcagaaaacatgttgggatcttcaacctgatcaaaccagctagtatacagtgcaaagtgacaaatctttaaatacaagcccttgacaccagggactgtaaactgcgccagatcaaagaatgggtaaatgtttactgatctttttacttattttccaattaaaaaaaattcttctgtgctcaagtaatgtatctaatttttaaaaatctgcataccatgtcaaaggacaaaattggagcactcttattttgtagattttcatttttttaatagcctgcaaaagcgtacttgagcagcaatgttgcttctgctcattcaactgcagaggtacaagagggaaaagtcaaatacagggggctgacagattcaaatattcacttcttgagacaccgaattatataaatgttcttccattaatgaaactggctgtatgccatttaatttagcctttattcagaaagctgctaaataaatgctagtgaagggggatcaaaaaataactattataccaaagaaaaatgactgtgtcaaacttaaaaaaaaaaaaaggagtaacatgaaactacatgagattgcccgtggaaaatccccaggctctgtctttaccttttctagtctgttttctccatgtctctttccccaaaccccatcatcagctctcttttgagtttatttaaattatagaattttctttaacatgatattctgattttatcttgtgacattaatcacagttatgcagctatatagaagccttgcacattataacatgtcctgctgatcataccacaattaactcttgaagtagaaaaaaagcaaggttgaataaaaattactcttcaaattatccaaacagcagattcactcaaaaaaaaaaaaaaaaaacccagtgaaagtaacatcgatttatgcattcctccaactatttggaggactcaaagatcagaaaaacaagttttcccagtaaggaagataaatatttgtttaaaaaacattagaaaagcttcacaatttaagactttctctttacttaaataaaaaactctcaagtctgccatatgatggctgccagtgacatcattgcagacaaaaaaaaaaatgaattaccctcatggttcacttgagtagcatatacatcagtcaccatttaccgacacagagcactgtcatcatacatccagatagacacaggagcggtactaagggagaagaaaacagttattacagctgagtgtcttacagtctaaagacagtcgagaagtacatatgccatgaattgaaaaaaaaaaacaaaactggagaatcacagcaaatgcactggtaaaatctacttataagtaatcagagagaacgtgaagtaaggaaaatagaaagtccaggacctgcaatattcagctatacctggcattttctttcattaaaacatcccagtcttagatttattttctcactcatgatcaaaagaatacttgataatttatttttctacttctttttaacagttagatgcccttaagtcatagagtaaaattggaaggaaagaaaccagtttgaaaatcattccattgtcatttatcttacaaattccagtttttctattaagcgttcttaaaacagacaattacaatgaactaagtagacgaataattaccttgtataaacatctttcaaaagctttcacaatcagcatctcaaatgcttagagtaaaggcatcgtatctatggagcttgtttaacactgagcacaggtatttgacagatgcctttaatgagaagggtgatctcaccagactcctagaatcagagaaatagcagtgcttaaacaagcggcttagattttctacaaagcatagtgtttgtgaactctttcatgtagccctagaataaaaatgaagacctaagaatcgtgatcaatacttcagcattttaaaaatataagccacactaacaggaaattcaaagaaatatcaatgactaataaacaaatgaagaacattcaatattactaataatcaaaaaagagcaatttcaaacaaggtgtatttttttttttttttttgagacggagtttcacccttgttgccaaggctggagtgcaatggggcgatctcagctcacagcaacctccatgtcctgtgttcaaacgattctcctgcctcagcctcccaagtagctgggattacaggcatgcgccactgcgcccagctaattttgtatttttagtagagatggggtttctcgatgttggtgaggctggtctcaaactcccgacctcagatggtccgcccgccttcgtctcccaaagtgctggattacaggcgcgaaccaccgcgcctggccagtgttatttttttctaacaaattgagagaaaataatttattacacaagatgaaaaagtcaattattaaaatgttgaaaaaccatttggaaatatacatcaaaactggagatccatttgtttgtttttgcctttgtctaataattttcatgctagaatctatcttaaggaaataatcagctaaaactagttatatataataattattgtacagttatttttataataaaaacatactttaaaattaaatataagaatgatgaaataaatatgacataacctaataatacataggttacaaagtaaaagtaaaaaaacaaaaaactctgaaagtgatctttttgacgaattaccagtaaaatgaataaatgctcaattgttgagtcagaaagtatgatggtatcctgtgtgtatgtgcacctgaaagtaaaaaaaaatcaaaaggtgaacattgattctgtctcaaaaatagaatcacatgtgagtttcttctgctatttatctcactatttacaaattatcttatatgtactcctgtacataaaaaaatttaaaaagtgaacttagagatagtttgtcttatatagactactgaaggttaattccacaagacctgcatagttatcttaaaataagtttacttgtgaagaagtgttattggggatttttaggaagaactttgtgaagagagtgttcagttttctttcaccaaagaacatatattcgagcaaaagatgatacttgggaataagctatcattctctggaactagcataatagcaatccaggaattaattatcctcctggttcccttgagtactgatttgtggaaacagcaactgagttttcaactgtatatcacagagtggtcaacggcacttcaggaggatgtgctaaggaggcaattaagacaaaaatgaaaccagcaacacagacagagagaaatacatttgtattacatggagaatgcagaaggatcaactgcagtgacatagaaaattaaatgtcccaaaatataaaatgagaagtaaaaatatttccaaaacttgacctttttataaaagtgatatattagaaaatttagtttcatgtttatatagttctttggcattttagaggaaaattactatatgaatcccaaacaccctataatccatctaagtccttgtttggtaaatatctcatggaattgactgcttattcatctgaagtgagtaaacacttatggagaacacagagctggatattctgccctaattcatttattattaaataattgtccatactctgagtagtcatttgttcattaattgtccaaaaattagctcaccactgtaaaatctgattacatgaaattacagtagcaccagaaaatagatgggtgataaaaatctgtgtatttcttatgcagcttttgagtgggttagatgttgacagttttgtgttgatacttgcctgctaaatctatttcctcttcagtcgtctcccacacagctcagatgagaacatagagtgtttctagatatctcttcatactcatccaaaatacatcaagcaaagggtgagggtaattttcagacaaaactttcccaaaaaatcacatgtttgctgaaaagaaaaaaaaaagcatataaaataaccatattttttaaaaaaagaaaagacaccatatttcaaggccatatttcagagctgtggttcaataatgatattagagaaagaaaaaaggaaaaccattcagggggataaatttctctaagactggactacctacaagcagcattcaaatataacatgatagcagaaatgaagagaatgaagaaacaggagagctcattaaagagtcgggcaaatggaatggtttctcttccaattcctctgttgcctctctcttctacacctctattccatgtacaactgattaaacgattcttcagcttgagtacattctttcggtccctaaacttactttgtacagtgttgtaagggaatttttaggttttaggcaaaaagaaagtactcattcccaggtgaaatttttggatatttaatagacaatcctcctgccctgaaaacagtatttcacttatttgaagtattttatgcattccgagtctatgttgcaaaaagtctttttcccttttgtggctccttgaaaaagtctatgctttacattaaatttgcttaacaagtgtggctctctgtggatgcgttcaatgtctctaacataatgagggaagaagaacctgaactaaatagtactaagaatagttacttaaatgtccaagtaaggcaacatgccttaaagatccaactttaattaaaaaggactatggagaaccatcattaaataattgtctagatacataaaagcagccaaagcaggaaaaccttcacctgtccttccaaattctaaggttgtaaagtctcaaaagaagtttcttttagtgcaattgttgctggtctagagtaacaatttttctgtcaaggaaaggataaatgcttttcatccaaggatcaggttacagctcacagaccccagtaggaagagaatagtgccaacgaattactgcaggagtcaacctgcattttcaaagtccataaataatgcaacaagagaacatatttggagaaggaatttattggccatgccttcatccatatgcattggtagaagcaccattctgactattttgctggtggggcatttgtattctactcaatgatttacatactgatgaggctatgagaacccagaacgatgttcctaggcattgctttttcagcactatgcaatttgcatctaagttcttgaaaaacagttaataaataagagctaaagaatattgcatgagaatgggagccagtgaaacctgtccacaaaggattaaactgggctgtctttcaacgtattatttgtgtcagatcagaaacaaccaaaatgatgcaatttatctgttgaaatgagaatacagtggtaagaacacttatcagaaaactcaatataacctgatagaaaaatgaatgaaaatatatcacagaggccagatgttttcacagaacagctcccatggatgtaccaatgtatacaatgaagaagtgtaaaatgcaagccttgaagaaataaaatccatgcccacaacattcagaactttactgtattgcatgcagcatttcaaatgcccaagctgtgcgactccccactcctccacatagccttgcacatcaactacctatggccacgtcacctttttttcccttaactagtggaaaatctagtattttgaaattcttgctatattatttaaggtagtttaaaattctagtaaaactagaaatgtataacattcccgtgaagaagaaaataattctagggttgttttttgagatactcaagaactgattttttttcttttttttttttttttttgagacagtctcattctgttgcccaggctggagtgcaatgaatgactccatctcagctcactgcaacttccacctcccaggttcaattaattctcctgcctcagcctcccaagtagctgggatcacaggagcacaccaccacgcccagctaatttttgtatttttagtatagacggggtttcaccatgttgaacaggatgatctcaatctcctgacctcatgatccgccggtgtcagcctcccaaagtgctgggattacaggcgtgagccactgcgcctggccgagaactcattattttaacagactgcaaagaggtataaagaaggctaggtattattctcacgttgcacacatacccgccaccaaggcatttttctctctttctttctgagtgatagatgctaaatgttgagaaaggataattcccttttagagttaaaaggctgaagtctatcctattttattgatttattcaataaatattgaatgcttaatatgtatggaactcagtgctacccttggaggtatataaacatgaaagagacatggacccttgttctccaggaacttacaatcagcaggagagagaagaggcagacaaattacaattaggtaaactagaatggaatacatagagtaggtaaagtacaaatcaagagccacagtgataccagtggggtatgggaggtccccaaacgctggtgggaacttgacctcagccagtatccaggctcttgacaccattgtgagaacgaattcaagaatgagttagaaaagagtgaaagtatagagatttattgaaaaatgaaaagtacacactcaagaaagaggagtgtgggtatactcaagaaagattcatgcaagggggtttggggctgctacctctatgggtgtctttaactaaagggtagaatatttataaacattcctggaaaagggtgatttcttggacttgtggtgccaccatttttacaccaaatatgaatgtgcctggaactaagacactggtgggtgtgtgacttgtatgttactgaggtcttaggagaaacctaggtcaaatccagtgccatggtggatccagtgggtcttagccaacttgacctacaccttggttttttagggtcttatcagctgtttatgcagctatttcaacagtttccacttgctagacatgtgaaactgctgcttggaattttctgttctcctgtgaccaccctgtctgtattgttcctgtctcagtggagttcagacaagagagagatacttctgcttggaggaaactgactccttcaaaggatagcctttttgctggtccgcaaacagataagcagttgagcaaaggcacagtgtagaatatatttaaagtaggattgtcagatttagcaagtgataaactttttaaactataagtattttcatgcaaataatgaatccaaatgtattttggaaacccgcaattcatctggcagtctcataatctaggcctacggagccactgaaggtgttagagtagttagagtagcacaatcaaggcagtgattcagagacattgctctggaaccagcaatgtgctggcttgaggttttaaaaaaaagatattttaaagatattttaggaaaaaaattaaatcagcttgaatgagagtagtgacagtaaaatcaaaggcaagaagaattttgaaagaagaatcaagaggacttggcaattgcaaaatatagaatacaagggagagggagaactcagaactgccacaagcatttaagcctgggtaacttgaggatcattgaaccatttcagaaagaaatcaggaaataaagaaacatgagaggaaagagaatgagcttagtttgtgacattttgagtttgcagagctgggagatcctcaaaaggaagatgtccaatggctttggagaaatgtcagagctagagatagagatctgagagttatctacttagagaagagaaaaactaaatctccatttgctttctgtctttacattatatttatcttatccttgatatgatgctgacttaattcccaaatagagagaaaaggtttacaccacaatctgtgtttgtatttcgtgtaataaaatagcattgctgatgctttcagtgttactattctgtgcagaggaatcattcagctataaggtgagaccaatttggattcaaatcccaacttttctcttacagtgtaactgctaaaacaactatttaaccggtttgacccttagctttcttacctgcataatgtatgctcataagattataataaaaacaaatgagcttttatagctgggcgcggtggctcacacctgtaatcccagcactttgggaggccaagttgggtgggtcacctgaggtcaggagttcgaaaccagcctgaccaacggggtgaaacccagtatctactaaaaataaaaaaaaattagctgggcgttgtggtgcacacctgtaaccccagctacttgggaggctgaggcaggagaatcgcttgaacctgggaggcggaggttgcattgagccaagatggcaccattgcactccagcctgggcaatagagcaggactccatctcaataaataaataaataaataaataaataaataaataagcttttatagataaaatatttagcatagttcctgccacatattaattgctcaataaaagacaactgttactcttattcttttactgtgaaggaatttttgtctgttttaataatcaacaatagcaaaaaagtctaagtgtacttaaatgttcaggctgctatatcaggtgacaaactgcttacatttaatatattgtacttacttgcgattttaaatcctaccaagaaaagttaagggtacacaaacaaataattggtgcaaaagtataaaaagcaggcaaatcagtaaaatttttcatttttccaattgcaaatgcattttaattttaattcttttttaattgacaaatcaaaggtgtatttatttaccatgtacttaattgacttttatgctgaatatacatatgttctgccatcatgaagatgtagtgaatagcttccaggaataaagtccctggcatttctaaagtaagctaagtaaaactattgatcttgttctaattaccaacacacaggactatttttgacattaaatgttatcatcatactaacaagactaatatttttatcctgccacaaacaattatttaatgatacagtaaaaccccaatgttctgaagctaaaaaggctttaaatgagtgcacaatattggcattgacagaagaaattgaacactatttttgctgactttgttgtattttaaataaaattctgcagttatctgtcatatcagaccaaagggaaaaccttatatattcataggaagaggcagttttgacaattcaaatatatgcatttccaagagaaactaaaatggcttggaaggttagttgaattgagcaactgtgcacaatttatttccaaacatactacatttctgcaaaaccatgacaatcacctggcatgaactctggttacccaagtgaaaaacttgcctgagataatctagtgaaaacaacaaatagcagttgttttcctaattgagaagttcggtaatttgaaactgaagtgaaaaaggttttagaaaggccactgggacaagagttctctaaggttccaaaaattttagtatatcctactaatatccgagtttattatttctctcctaagctggtgatatcactcctgagtccacctcatagatccattaatcactaggtgtaatagtacaatactttaattcattttgaatccttttgagtgtcaggtgtatttcacattgttaactgacttgtatggaagactttgatttcctgtgtgatgtttgtaaattgctgtttgtctctttaaccacgtactttgaatcatcgttttctctgggaagtcaacatttttctatggccatgttcgtcaaagaatggtcactggaccacctgcatcagaaactcttgggatgtttgttaaatagcagatttctgggcccttcccagacctactgtatatagatgtctatgggttaagtttaagaattcttgagtgaaccttaaatgcattaaagtttgattatcaatgttctataggccaagagatgggaagaaagatttcaatcttttttttttctaagaagaatcactttttatttaagtagatcggaacattcaatacaatttgtattagtctgttttcatgctgctgataaagacatacccgagattgggcaatttacagaagaaggagctttaatggactcacagttccacatggctggggaggcctcacaatcatggcgaaaggtgaaaggcacgtctcacatggcagcagacaagcaaagagaggttgtgcagggaaacacccttataaaaccatcagatctcatgagacttattcactatcatgagaagagcatgggaaagacctactcccacgattcaattgcctcccatcgggtccctcccacaacatgtgggaattcaaaatgagatttgtgtggggacatagccaaaccatatcaccatttatgcagaaacttaattatttgtaatgtattaacagatatccaaggaagacaggactccagtcttctcagcacgttcagagctaaagctaatctagatgcctctccagagatgtaactgtttggttttgtgggtgataagagaagcttaaaaaatagctatagatctaattcttatgatacatgaaaacatttttaggagaaataaaagcaaatattccctaacattataggatatatatgtttccgtggctcaggaggccagggttttttacaggagcactgagaaatttagggaagtattgttttcttacagtttcattggtctgtttatctatccttcaccaggtggcataaatgctccaacttggttcttctgtctcaagattgttttaactgttttactttttttttaatttctatatgattttagaaagagcttacactttccatggtaggctgagtagtggccccaaagatatttaggtcctaattcctggagcctaggaatattatttatacagcaagagggactttgtggatttgactaagttaaggattttaaatgggagtattatcatggattatccaagtaggtgctaaatataatttcaagtgtccttataagagggaagaagagggagacttgactacagaagatgaaaaggcaatgtgacaatggaaacagagattggagtgacatggccacaagccaaacaatgctgggtgccagcagaagttaaggagaggaacggaacctccctggcactgactgaagaatgtagtaaaacaaaactctgcaaagaaacaagttggtctatatggactagtcacaaagggggttaggatgaactacatgcatcactccgtgtgatgaaagagcagaaaatgcgtcaatggaggagatcgtttcacgtatcctgactccatggaaaattattattagtactattagtttagagatgggggtctcactctgtcacccagcctgcagtacagtggcacgatcatagcgtcctgcagacttaaactccttaaactcaagtgatcctcctgcctcagcctcccaagtagccggaattataggtatgagccaccacacctagcttgctccaggggaaattattaaggtctcgtaaggtatgtgtagtggctttaagtggcagttttgccaaaaattatgcagaatattcttttgccaaaatttatgcagaatattcttcatatagttggtccttatttatgaccttagtaaagaactgagggcatttatcatggtactgtgacattgtttctacaggggactaaagtaatgacagtccacctacacagattcagtgaccaaaaaaaaaaacccacttccattttttgtgctgttaataaatggcactttacatatataaatgtaaattatttgaacattttgcaaggtagatgttgttatctttaacaggtgaagaaactgggttcaaagaaatagtttaagttactcaaagtggcagagctgggaattcaattcaaatctatttgaaacaatgtagcccatgctttttctatatttgatatatgagaatgtgttagggaaaagtatgatagtatgttctctaaattatcccatcaaatacaattggctcaatcaagttttggataagaattgaagcttcctgtacaagtaagtgtctaaatacaggtattgtgatagtttaaaagagacttaagggaaaaaaaaaagaggcctgaacactttagttaattcctttgtatgtaaaaatattgatgatttattgtgaaagttcaagatcctcttttggtattctggtgtcaatgaagagcgaattcatttttgcacaacgaattcaaggaaaatcaggactgaatttgctgcagcaagcaactttagatacattccagtgttccaataagaattcatcagaaaactcagaaatatacagcataacatatgaatgaggtggttttagcctaaaagtttttgagaagacgttctgtgtctcaacatggtggttgtacagtatttcattttaaatgcactgaagcttcactgccttccaggagccacttaatactatccctttgattggggggtgcaaaaatgatttggggttagatttagttaataatgagctgtcctttctgaaaacaattggccaggcaggttctagcttattaaaatcaaccctacaatgtgatgataaaacaatattgaagattacttcgatagaagtttatctcttatgaagggagcacacagctgttttatctaaaatctgattctcattacctaagtattgtttaagaatgaagtcgaaacatgtagttgcatgtcagttgggctggggattttatctgccaaaatgccttcctctgatacttagggaggtatttttttaaaatgatccagaaggctgggcttgtggctcacacctgcaatcccagcattttgggaggccaaggccggtggattgtctaagctcaggagttggagaccagcctgggcaacacggtgaaaccccgtctctactaaaatacaaaaaattagctgggcgtggcagcatttgcctgtagtcccagctactcgggaggctgaggcaggagaattgcttgaaacctggaggcagaggttgcagtgagccaagatcgcagcactgtactccagcctgggtgacagagcgaggctccatctcaataataataataataataataataataataataataataataaaatccagaagataaggacttggggacataatcagagattgtaacaatagttggatggtctactgagtcaaatgatggcaatacataaaataaggaaacctgtttttctcactggaaaagcatgtttttcttgagatgaccaaatatagtcaaattcagcaagtatagttgtacaactattattgttcctaaattttgtatgtctcttagagacattcatttacacattttaataatgctgagacaattgttatccaggactgaccttgatgttgttttaatttgtcttgatggaatcatggcttttggataattaagtgattatttgagtttctatacctaagaagatttactaatgtgttttcaaaaatgtaactgcaccattttgagaccagcttcctctttgctgaaagttaatgttacttttaatacattgctaagcacaaacgtggggctcatgtcatcatgcattattgcacagataggcaatgtctgtaatctttggatggtacatgggtctgtaccacattaagttgacccagagaatatccatctgggaaccaagggattcttttttcccttaatctaggattttttcatcttaaaaccaacacttcagggtagataaaccataggatgactccccaataatgctgaattccttgtgtttatgcctttttgttttgtcttccttttgaatgcaggtagagcctgtgatttgcttctaaccaatagactatggcaaaggtgatggatcatcacctccctgattagtttaggtgagacctcatcttgatggacttgagggagattctctttgagggattgatgaatgaaatggccatgttgcagaagcccatatggcaagggacttttggcagcctctaggaactgtgcttgcctccagctgatggctaacaaagagctggccctaggtcctacagctggaagaaaatgaattctgccaacagcctgagtgaggtagggaggagaatcatccccaactaaccctctagatgaaaatggagcccagctgataccttgattgcagtcacgtgagactctaatcataggatccagtcaagctgtgctgaccccaggctcctggcccacggaaactgagataattaatgtgtgctgttttaagctgctaaatttgttgtaatttcttatgtagcaatgaaacgctaatgtaagatttttaaaaatatcaagtcaatgaatgaatgtctttaatgtcagagattcgggagtaacctggtgtttttcactcctctgctcctgccatatagagaggaaagaggcaatctgtactgtgaaataaccacagaggttggttaatgtatgccaaaaataggaggatcagcagctgctgccagaggcctggcatttttttctaatatttgtagcttaaaaaacaagtgtccagtgttgtgctgcattgactagctaaagagggtgaaacagaacttgcttgttagggctcagttaacattcattatttagatatttttttagaccgtctgttttcagcagtctgactctctatacattgttataagaatttgacagattaatctgagaaaaaaattacattcaatcaagggatacttttaagatgttggagagttgagtggacagaaaaaaaataaacatacacagaggaatgcagaaaaaatgtcacgcaagagaaattttataggttgcttatcgctaaggtgcctgcaaactcaactgtgcttggtcatgcttgtttctgattgtttcctctgttacttttggcttttaaaataagtgctctaatatgtggaccaccactagtagtttgacagatttaggtttacttccttgctgtcctgcctatcttctttgagtctccatttctctaattatatattatatatttgtgctacgcatttctactatagtggattgggatataaatgaaaggaaaaattaagaaataccaattcaaagaggagcaaagatgaattgttcccccaagctaattaatctattcgttgcctcaaatatttgacttttttgtggttagaacatttaagatttactcttagttcattaggttgatttaatcattccacattatattcaaaaattatcacatcactctgtaccccataaatctatacaactataatttatcaataaataatttttttaaatgctcccccccaaatatctgagagtagtgtgtatactctttacaggcattggaaattatttacaaataatatgtgattcattatagctacgtatctttccatcctgctaattactcaaagattagcaaatcaaagattgagttggggagtttttcacagcagctaaaatcaaattatttatacattcttacaaacatggccactgtatttttcccgtattacctctctgaccttagatatatcatttgataggtccagatctcaatttcttaaaatgtaaattgagatattggaaacttattgttgtaaagttgaactgtgaattcactgtgatcttaacacatacctcacagagttgtttgaaagctgaaatgagaaaacatactttgcattgtatctgactcttggtaggtgcttagtaaatttacacgatcattcattttcttatcatttcctttgatttctagtttaattttctatttatgatttgatatggaggcagcaaaacctagacactatgtaaaaataagtagagacttccatagaaggaggtgggtttttttttctctcacaatggagtagttgcatttaacatatctatttacaaatgggtctgtcttccaaagcattataacccgtaattacaacattcaggcaatgatacccacacaggtaattcttaggactgtataccacatgacagtgaattcagctggggctttgcatatgcacacatgccatggtgagttctctctatttcctaggttgtggcaatgacaagatcatttattgctttccattgtcttgttatttattgtcacaacaatactaagcataaagcctcttcgtaattatgtagcagaggagctcacaaaaaggcattccataaatataaattagaattctcatataaattgtttccaacagtaagtggcattggccattgacgtattcattttattgcattttgaatgcaggattgattgttggtatctagacatcacctatttaacagagacatcttttctgcattgtgagtcactcacacagttttaacaaactgccaagcacattcaaatgtgtacaaaggataggtggcccaatgacatattccacacaacacagaattatttatcccacctgccataagtgtaatggaaaggcagaataataataaactgtatttcttgtaaatagggacacaagatttaagtctggagctggaataagccacatgtaggcacaatgtgttcatgatacataacagctaaattggtggatgagactataaattgtttgcatttagaagaggtgacttaatgaagaaatggagccagaataacagagtctcactgagaagcagaccccacaaagaactgtgttttgtaggcagaatgaagtgccaatgtgcaaaatatttccgaatatgacttttgacactgccatggcatgtttaaattggtggcaatttgtagcagtattggaatctagcagcaatataaaaatatagagggaagtcaactgtcacgaccaaacttggacaacttcagtgtattgcaggattgcaaaacagaacagttccagttatgttgctagctacaaggactgaaaaagtcaggcacagtccctcctggaacttcctccaggtctcagttcaaattcggaaagtcgtataagccttacccacgatctgacctaaccccgtgccttagcacttcttgctcatcttgcactgctttatttttctccaaagccctgctgcttttcttttttactaccaccccccttcactctctctctctctctcacacacacactcccatacacacacacacacactcacacacaaacttaattgtctgttttccctactgaaatatgagctccataagggctaatgtttttgttttgttcactgctgtatatacccagagcctacaggggtacctaggacatagtaagcactccaagtatttgtctaatgaatgaatacagtatgaaattagaaatcactgcatcaaattgccctatattttaaaggctggtgagttgaggcagaggtgtcatgtgcaagagtgtggcaattggtatacagtgacaacaccttggtacacgtgcttcagagagcagaaactcttgaccttctaacattttgaaggtctaagcctcaactctcctaaatacctggcagacacagcactgcccagcccagtcagcgtgcttatcggcagggaggggttctgccgatctgacagtaggaatggaatcacatcatgtttagagcttctagccatgtcaagggaaaatttggcaggtggtgtatggctgaaatgagatctctgagctcaatattatcccattcaaacgtccctttctcattaatgtaaagctaagcaaccaaccaaggggaaaacccacagttctttgtttccatcactgaagaaaagcaagtgtctttttaggggaatggttactgtagacagactcatagtcagtaatgggttaaaggtgctgaaagcccatctgtaaaaagctagaattactaacatttactgacagcaattgtgacaatggagaaagattttcttaaagctaattcaaacaatctctgagtggtcatttgtagcagtaaaatagtttgctgctgtgatagaggctttagagagatttttttttccccttatcgttgagctaaccaagcacatattgaagctcacttgggaaaggagggaaggaaatgtgggagacatatatctaattaaaaagtattcgttcctctgttctcaaactaatgtgctacgccattacttcactacataatgagtgaaacattggtgcaaaattaggcatcaccttaggacagcatgagccattaatcaaacaataattttaagggttgtcatggaaggaaggttcaggtttattcttggcttttttttttttaaagtagtgcaagctgctaggtagtgaagctctggaaaaaagaaacatcaaatcttaaaaattagaatcttttcctttaaactgaaataacatgcctattcattcttagaggttgtcacttctattcagaattgccttcaagattttcttttgggcttctcatcactgaaagtagtttagtctacccaaaagaagagataagtgaagttaggaactttaaattgttggttaaattgggtaaaaatttgggcaggtaaacttaccactttatgcttttctctcccatgtcataacctatacgaagactaaatacactactgtagcttttacacagtattaaaatcacagtttgaaggtttgaggtattaaaatgaccagttaattcagtcaaaaattaaacaaatggaatttggctgatttcattgccttgaaacttgttgatttgaaatttctaaaactactattgccttgacattttttcctggccgcttagacttttaaaatgttctcactgtgtcagtgtggatgatggaaatatctgtttcattcataacagtaaaatgccactcccatgtaagattcagaacctattgttttaattctctgtctccttccccttaagagcaaaatattattactcaattgagttttgaaatccctctgtgtttgaaagaggcccatttggtctgtttgctatggctgctgacacctctgggccctgcaactacatcagctccctgggctgtgcatatcagagctacaatgctgctcacacgagaggacagatgatttctttctgcagcacaattgtattcccccaggacagctaatgatcaatagtcgtatcttcaaagaatttgccatttgtcagtaggaagacaggtaagaggagacttgggaacactaaatggagaaaaataagttttatttccatcagtgatgtgattggtaggcagttcagcagatgaaacaagaaaggctaaaccaaaaggccgtaagttaaggaagtctgcctgcactatgttatagcaacaggagagcagcgacaggtaccaaccatagaaccttaaatgctacccagaaattgattgcagtctgttagtcaatcattaaatgaaatggtaaaaatgaccagtaagatacgttgtaatgaaagtagatctatgaagtaaaactttcgaaggagtaaatatgaatttacagccaggtaagaatcttagccaattaattcatactattaaaatttaagctaaaatcaaactaaatgaaaaattaaaaggatatcatatctggattacagctgagaataaaatgaaacaagtatgatatccagatcggtgcatttttttcaaaaaaatttttagataattagctttacataacccatattgatgggttgacatgttaccctttcctgacactctcaggaacacctggaaaatcaggccatttcttttaccatggagccttattgatcagtttaacagaaaataccacaaaatacggatttccaaaattctacgtagctgcaaatagaaagaattcaaaatatttagaattcttgactgattatttttccaaaggttttttaatctttggaaagatagaaaaacctagcaacagtgattgcctttagagagggaaactgaggcattaggaggcataattgggaaacatttttaccctatatactttggtatcttttgaaatttggttaatgggcatgtattatttatttatatgtatctttttaaatacatattatattttcaaatttatacattgaaacatttaaattatatatttaaaaatatataagtatataatttaaaactttctcaaaaatagtatttcctatctaaggcttgagtctttgggataggcttgcttctctgatccctaataggtctcagcacctaatataaaggtgaaataataaaccactaaaggctcactcaattgaccataaccttctcttaattcttctctcatttgttgacccaccttgccttaatcaatagaaaattttaaaactcatttcttttacttttgtaatatttcatgagagatatcaacatggggcaaacacacatatgcacaaatatatgcataagcactgatagatttataggcgtatgttaaatattaaactttcctttgagaaaaggaagatttggcctcttggagaaagtcaattaaggactgaaagtgggactgtgaataagtcaggtaagagtttgagaggaagcaattatatttgtctattgctacctttcacctctagaactctagtgaacttatgatgttatcaggaaattaagaattcagaagcctccattttactgtctttttcattggacaggtattatcaattcagtaggtgtgcataaaatggtagagaaagtttttaccctgtaaacataggcacttcagatcggggcttcatcgtctgttgaatctatctcccccaacccccaccaatttcctttttccttttagcatcctaaaagaaaaggggaaaagtaaaaattgtcttcacacggcttcttcgaaatctgggagtaggtacacttatctcaattttcctgggttaagattagccttcacactagtgcattcattaaattgtcaccagaaagagtacagcacagaaggaagaaaaaagcaatcttccaactgtggagattgaggaaaactgtgtgcttaatgagaaagaagagtagcacttaccattactatgatttcagaaaagaagtacagtgatgaggcacagtgacttttcgaagagcttgttatgcatggtctagaaaaaatgtcacatgtatttcccaggacaaagcccaaaatgcacagtaattggcagttacaaattagtggtgatcagctaaagtgtgtcttatttgtaaaacactatctcatttcaaacgtttcaagttgtttgcaccacttgaaacataaccaccaaggtttttctgaattggacctgccacggcaggtccaattcctaaatcagatatttaggaataaatttggtaaaatcacatataacctacacaccaaaaactatggaaacttgctcagaaaaactaaaaaggacctaaataaataaagtagtatactatgttcatggatttggaagctttactactaagaatcagttatccttcaattgatctatagattcaacacaatctcaatcaaaccccaaaaggctttttaaaaatatataaatagtgtattaataatattatacactatttataataatattataatattatttataataataatatatactatttataacactatttataatattataacaatataatattatacactattaataatattatacactattaataatatacactatttaatataataatagtaataatattaatagtgtattaatttcctattgctgctgtaacaagttcccacaaacttagtggcttaaaacaacacaatttatcgtacagttctggaagccagaagttaatgagtctaatacgggtaaaatcaaggtgttaatagggctggttccttctggaggatgcccacaaaagaagttgaaattatccttctcctttagcaataatctgtttgtttagcagtgataagccctgttcagcatgttagagaatatttgtttcataagcacttgagaaatgagctttgatgaagaattatattttagtagccctaagtatttacttatcaagattcttttaaatcttttgacatgttgagagaatcttgctattaattatggatgtaccacagaaaagttagaagctggtaagattgtagcaagtcagatcactagggaagtttgtaagaagtctatcatttccttgtaaaatgaaagttttcttaaagttgtcataaatctgtccttagtaatattttagtattttcttttaagcaatataaacctatgtttacattataaataatttttatttatgggacaactaataacatagattaattttaagctgtaaatataattccataattcctatagttgtacagcagacagaagtttcagtacataacctcatcagcagtctagattttttttaaattaaaacttcattctaaacaaaaacctgaatcttacattttcccttattaacattcctatatttaatataagaaagcacaacattattttgaattgctcttagtaaaatatcaaaacaataataattgatatgcgcagaagcagtattaaaactttttcttccaaaccacacatgccagtgagcaccacaatagcagtttcctattgcttttgtaaaaaaatactataaatttagaggcttacaacaacacaaatttattatcttacagttctggtggtcaaaagtctagaatgggtagacagggcaatataccttctgaaggctctaggacagaatctgtttccttgacttttccagcctattattactaccacagccatcaaatggaattatctaagagccacattaggatgaatgaagggaacttataattagaaaaatttccctagggtgttttaaaatttgccaccttttccccacctctttgcatggagaaatgttgggatagaaagtatgcttataatgtactgattcacaatttagatgaagtgcttgtttgctacttataaaaataaaagtgatctttggggtagaaagctttcacaaacataattgggaatgctagatgctacccctatgcagcaaatgcctagcgctttccttttgaaccctatgacagatgcaaaggaacccatcctaaaaaggaagacaagctgagccaaatacttacttggcagatctcgtgtctttcttactgataccaggacatctccacaaggacagatgcagtgcctggcttcactgtcaagaaaacgatattatacaaaatgaaataatatctgatagagaacagaaagtggttcttagccccagtatgttctgagagttatatccttcttaactatatgaaagacagaaattgattatataaaatacaagaaaacctctgaaaatttgtgaacgaagtaatgataaataggaagagatgattgattggaaaggtcataatacttttatggaaaaaatgttcaagaaacagcatactcagaagtagctttgcaagaggacttatactttcagaatagtttaaatttttcaaaatatttcagtatttattatcttatttaaactagatttattcagcctaaataagagaaggtcaaaaggaagataatgattttctattataagtaaaggaaatcaaatattaaaaatatgatcataaacctgctaattagggatggtacacattttatggctatttattgagggcctaatatgtgtcaggcactattccaggtactcgagttatagcataaaaaaagtcctgctctcatgaagcctagaccctagcagagaaagagaataatcacaaataaaaacgtatgatatatcagattatcataagagttaagaaaaataaagtagggtgagggcacagagagtgatggggagatgggggtgtctttctaagattaaattcatgtgacactacatgaaaagaatgtctaagtagttttccagagagaaatttattgtaaagtcttatgcagaaggcattaatcatccccaatcatctgtttagttaaggcatgacttttacgctctggggcttatgttttctgtatgtgagtttttgttggtgtttcttataatttatttcctttccagttgaggaaactttaggtcttcagaaattagttccaatccattaagattaaaggtaatcaatggtcttgctcctgaagaatgtcagaatcatttaagggaaacctcagttccactatatcctggttaacagtttcatagatgaatagaaagggggaattatgtgccttgaattttctaggaagaaaaaggcaatgactccaaaatagggctacgagagacactaatgaaaaaaaaaaaagtacttgaactccaattcgctctaatcagctggctggctgccagtcgcagcaactgaactgctttaagaaacttcagaaaacataaatcttttacaaataggaaactcaaagtattgcttaaaagtgaatagttcccctttggctgtacctacatcattctatgaagtagtttgcaaaatataagttttggtcaagtttcaagtggaatataattatcatgactcactttgtagtgtagtgaatacagtattttttatccttcctattttaggaacttggttaatctacttaggtgtcatgccatggaagggaaaggattttctggcatctaatttaaaaaattctttaatataagtgtttggcaagatttttagtttttgttttacattttgttttgttttgatttggtctactcagactaaaccagcaaactctgtctaggcatgcccaagttttcactctaaagacatcaattctttccaaaactgtcacggccaagtccctgctctcaatgactgattcaccaagaaacaaacttcaaagcaggtagagagaggtctttttgtattctggaggggcacattcttggaagatgtgcataatctgttggtatggagaagatgtaaaagggcatatttaaactaaaaagagtataaatgaaaagtgatgaaggtccaaaattttattgatgtaatttctattttcacattagagaaattaaaatttatgtgcataagtagactgagccatgtcaagtttcggtaatttatcacaaagtgaactagatacagtttgaattgttcccctgaaaagttttattttccttttttcaggatcagttagctgttagtaatctccacctctccctccacaaggactttctattctaggctgcagtaaggctgcccaccactgctactgccattcaatctattttccagagaaagtaaataacagaacaagcaggggaaaacacaaaattccaggaaatgctgccaaattgccctaccaagtaacaaagttaatgaaagtggtcaaggtggggagaagtgcagatttcaaaccataatgacctcgttcaaaacaagatcacattattttgaaatttgggctcatttccggaaactcatggtactgcaattaatgaattgttcctctttttcttgtggttattagagtgccagtttcagatagatcagggtttcttaatcaggggcacttttgccatgcagccatcattaggcaatgtctggagatactgacacctagagaataaagcttagtgatgtcactaaacattcacaacagcccccataataaacgctcattaggcccaaaatgctaaaagctttgagaaagcctggaataaaccatcccaaaactagtagccatttggtcttgtgccttaaagcaaaggttcccactatttgtgtctctgcttcacagaggcaatgagatggaatacagagcccaaagttactagaggaaatcttgggagtcttcagtccatagggggctgaaatcaccaggaggatcactgaggaggagaccatgggagggtctctggggaacaacagcatttacagatgacgagtagaagaggagcctgtcatagactcacagaatcataaaagccaagcacgaagtttcagaagtggcatgttcggtgagacacattttagaatgtgtgtttgcattgacagtggaggtcaccgcaacagcaatttcaaaacagaagtaaaggtggaagccagatcacagaacattaaagaataaagatcatcttttcaataattttagagacaatagaaagtataatattttgttattagaaacagaaaaatccatatttcaaagaaatatttttattagtttatctggtgtagaggagacttgaaaatgtttatagctaaagagaaggagcaggctgggcatggtggtgcatgcctgtaatcccaacactttgttaggttgaggtggaaagatcacttgagcccaggaatttgagaccagcctgggcaacacagtgagaccctgtctctacaaaaaaacaaacaaacaaacaaaaaacacacaattagctgggttgggtggcacacacctctagtcctagctacctggaaggctgaagcaggaggaccatttgagcccgggagtttaaggctgcatgttgcagtgagccatgctcatgccactgcactccagcctaagctagagcaagaccctatctctaaaaaatagatagatagatgggccgggcgcggtggctcacacctgtaatcacagcactttgggaggccgagacgggtggatcacaagatcaggagatcgagaccatcctggctaacacggtaaaaccccgtctctactaaaaatacaaaaaattagccgggcgtgttggcgggcgcctgtagtcccagctactcgggaggctgaggcaggagaatgccgtgaaaccgggaggcggagcttgcagtgggccgatatcgcaccactgcactccagcctgagggacagggcaagactccgtctcaaaaaaaaaaaaaaaaaaaagatagatagatagatacatacatacatacttacaaggagagaacttgaatacataagaggtgataactaagggaacaaggttacagagaagccaacaagaggtggtgttcagggcacagataggctggtcttgtaaggcagaacaatacctcctctaggactagataagtgtgagtatagatgaaaaccattttgttgatagggaaaaggaaaatgtattcattcaatatttactgagtatctaagatacactgtattgaaaaaaattatctgaaaccatgtttttcctctgccctcacaccacaacaatcatcaacatagaagacatctgtgacgaaatgtggggtgtagttttccctacacaccaagtggtagacgccagctagatgtccttcaattcaattccgaacctgtctacctggtgataatgtcagatcccagaggtagaaagctcagtcctcaaaactgtgccccgtcttccagacagccacaggtctaggcctctggaacttctgattggccggcttcaagtggagttcccatgaccccctcttgggttcaattaattttctgtaacagctcacagaactcagggaaacatgtatttagtggtttgttataaagcaagcttgtccaatccgtgtctcacatgtggctcaggacaattttgaatgtggcccaacacaaattcacaaactttcttaaaatattatgagatttttttgcaattatttttttagctcgtcagctatcgtttgtgttagtgtattttatgtgtggcccaatataattcttcttccaatgtgacccagggaatccaaaaaattggacacccctgttataaaggattttgcaaaagatacagatgaagagatgtgcagggcaaggtgtgagggaaggggtgtagaacttctgtgccctcccggggtgtgtcactctccagggacctccatgtcttcagctatccaaaagcttccaggatccagtcctcttgggtttttatggaagcttcatgacatcagtattccttcccccaggatatagggcaggaaccttcctgggaaggactttagaaccagaatcagaaaggtgggggaagattagagtcctgccttggggcaggtaaaaagaggataggagaaagattctgtttcctaaggcctaacacacccaacattataacaaaagactctaactaaggctatgggagttatgagccaggaaccatggacaaaaaccaccatgtatcataagaccacgtgcaccaagcactatgctatggaaataaaaatgaatacgacatggtccctgacctcaaggagctcagattctgtgagaatccgaaatagttttttaacctccaataaaaactatgagtcaaaagcttcaattggtagaatgaagagagttgattgaacagaagcctggagacaggtgaaggttattcatccagggcgtctgcagaaaaagcttttggttctgagggcccagctgaggctgaagggttatctatttattgtggtccccatattcacaaatatattttcttcagcattcttatggagtgagttgtgtttccccaaagtcatatgctgaaggcctaaccccaatgtgactgtacttggagattggggcattaagaatgtaactcgggtgttgtatgaggtcatacaggtggacccctaatcccataggtgtcctagaaatttttctctctctgcccatgcacacacacagaggaaagaacatttgaggacacagagagaaggctgccacctgtgagccagaaagaaggacctcaccagaaactaacgccatggtgccttgatcttggactccagtttacagaactatgagaaataaatgtctgttaagcacccagtatgtagtattttatcatggcagctccagctgactaataaaagcatcagttctcacgcctgtagtcccagcactttgggaggccgaggcaggcgggatcacgaggtcaggagttcaagaccagcctggccaacatggtgaaactgcgtctctactaaaaatacaaaaaaaattagctgggcatggtgatgtgcacctgtaatcccagctactcagaggctgaggcaggagaattgcttgaactgggacctgggaggcagaggttgcagtgagccaagatcacactactgcactccagcctgggctacagagtgagactccatcaaaaaaaaaaaaaaaaaaaaagcatcagttcttccacccggtcttaggaatagcaaagcacacagtagctatgatctagagatgaagtgtgcagagagaataggggatcaaggagatcctcaatactggtccagatacagaaccatggaattcatgctggatagagatggaacagacatccagagaaaatgctgcattggaagaaaatggggaagacaatgtaatgacagcaaaaggtaaaggaacagaaggaagtcgatgatagaaaactgtggtctgagattcagacactagcactattatttctgtataatggacagtttagggtgagggcaagacacaagatgtgggtttgagaataggtgactgcagtgtatgaaagtaactgttactgaagtcaaggaaacaaagttttaaaatgagttacttaagtaggtttttaaataactcaggccccagtatcctccattgaaaatatagaacaaccagtacattgataaacaacagtggtggaggtaaatggagatacacagctgggtgcatgagtgatttggtttggattagtttggtttataactttaaaataatcacctgaaagtagcaaaaggatcctcctttcctggttgaaaaagataacggaatgtggaagaatctgagtggtttccttagaaaatgctctaagaggggttgtgagttatgtcctctgagggggagggtgggaagagtaagaagtggggaagaaagggtctgtggcttaccctctgttatcccttatttcctaatctaaaaaattaagataaattttagagcaaagcagctctgcttcctacttttgggttctatgaaatgcccctttctgctttaaccagtttaagcctgtgttccttgtttaggaaaagaaaaaaaaagttaatttctgattgagaaactaaaaattatttgaaactcattgtcagagaaaacagcccagcaaaagaaagtaaaaagtcatgttggattctgctctgctgatgcctagtcttggcattctactgagagttcatttttgttagaaaccataacaagctcctaagccctccatgcgattattagtctaaggatctcactgcctagagggcataagttccaggagccatggactggtttggctgttccatgtgggcaactcacccaggataacttgataatatcagaaccatttgagacatttcacgatgcttctagtgatagttttaagttacatttcatgagaattcatcaaaaccatgacgtgaaaatagaaaacatttcttaatacaaaatgagcgcaaataaatgaagagtatatttatggccaatagtatgtaatgtattgctagattttccaaagaaatccccttaatgtttaaaaactacagtaaaattaattacatatacacacatatatatgcatatatgtatatatatacacgtgtgtactacatatgtgtgtttattcaaatatacatgtgtataattctataagccaaaagtattcattatataaatatagattagaaactagtaaaaaagtgaggaaaaatgaagtcctggaagtatggggtgagatttttcaatatatactttcatgttaaatattttacctgtgaatgtattgcttatcttccaaaaaggaaaatgaaagcatttaaatattatagtcactaaaggaaaaaagatgagatgagagatcagggcttgttttagcatttttgatttcctctggattcacgattcacatgactgcatagtttagcttttttttttttttttccttgaaaaggctacccaagcagggattgttggttttattgcttggctgagtgtttggtcagttgtttagtttttaattgtgttttcataataaagaaccatctcaggattcattattccatgcttttttattcctcattcccaagactacaccttcccttcctccctctttatctatataaatattattcctctaattcaggttccaggatcttccctttcagaattttgtatgtctctaactaaagttccaagatcttccctttcagaatttgtatgtcatttgtctcaatcccctaaaataaaggagccctatttggagacattatcgccccatgtgaaaacttactatatccctgcttatactacagcctacaagactctgaggactgcaccctgtatttccaatagtacttatttgtaccacatttgtattacatttattttgttcacgggatattcaaagagaagcattgcatttctagtattgactttgcttggtttcagttttattaactaatgttttaatcacttttaatgtgtattattttattctcatcttaatcatggtggtagaaaaagtagtctcagactcaaaaatagggatttgatctagcacaagttttcagagtcagtcagaatttacaggctgaatgatctttataaagttataacaaatccttcctgggagagtagccttggtaaaacactagcaatgcagggcttgtctgtccgaagacagtggaaaaaatcaacatcatgtctatctcaattgcagcacgccaactcactgcagtcccttccataggtgaactttatcaagtgtgaaaagcatcccgggaccatgggagacacatcagtagcagggaaaatatatatctttgctgcagctcaaggagatgcagcccattcaaatgaagataaagagggacaaacaaaagaattacaatcgaaaatttgttgctggactatcagtagaggagacataattctgccctttatcattacttgtcatgccagtgacagactataaaactcgtactgctcaacaattctgtactcgtcactttctgagccaacttttgccttggaagatgcttggcatgttttagacatatgatttattgcctcatttagtcaagcttgcacaggcaacaatgatctatatttttgtaaattacaaattagccaactttcacttattcttagtgacagaagtgatatatatacatacatatgtgcatgtgtgtgtatgtattctccgaagaacaccatttatttattgcttggtaaaaaaatttaaataatgacttctattccttctgcctgtccaagaaaagaaaatttatgcaatactgtagaacagaaatgcagtcatcctgcatcattgtttttcaatgtttattgtcttggaaaaaaacagcctaagcagattccagtactaataaacagccctgctgtagaggttattggctatttaaaggccatattacttcattttgctttccattttgcaaatacattttacactcttttgggaattccttctaaaatttgggggagctctctggcttgacagtgaaagggaaccattactcagcaaataagcaaaatgtcctggaaataatattacccatttaaaaatgactccttggacattgattaagttgaaatgaagtgcatgtaggcaatgctagtttgttgtcttacctagggagagaaatcattttctagagttcagtagtaaataggcaattcattttgacataacgaggaagagtgctgttaacagccagaggtcacaaaaagcagagatgaaaaagacctattagatcattttctccattccctggagaagagggccaaattatatttcatagtgctttttccagtttagctttcaattactcaagcaagggctttcaccacttcagactttttccaggatctttatcttgtttatgaccccagccttcctagatacattgacaaagtacgaatcttcgtcagaatcaaccctgcaggtgatcacaaaagtactctgtgctcacaattagacctgtatgtctcattttcttttctccttcaatgaatttcaaaatcatttccttggtaataactccttttgtccttccctactctacctctgtgttctgcattcttaatcacgtccctttcactctgagtctaaacgagagctgtttcttggaagaataatctgaaacaaattcctgccatttccaaaggcaaatgatcattcagaggaatgctatttggacagattaccaagaacatctcgaatgaatgaaaaagagaaatgagttcaagagagaatgagagaagctgaagtggagactgcaggtttagaaaactccttcacaaaatccctcgcaaaatggagtaggtaaatgagacagaagctggagaaaggcggagatcaaagaaggtttgctttctaggagagagagattgcaacacttttatctgaagatggaatgtctcagtagaaataccgaaaatgaggatgcagggaagagatgggacacctataggagccatgttcttgagcagacaagaaaggatgagatcctgtacacaaatagagagggtggccttgtgtgggtgcagggataactcgttcattttaacaagaaaaaagggagagcatatgaagagaggtgcttatgggcttatggtttggcaatttggtggtgtgactggtgacctcagctctctttcaaaaaagaaccgaattgattttatggcctttaatatctgcttggctactgcaagttttctgacttccatagcaaatgaagacaaagttttcagtctcttcttttttgaaataatttatttttaatttttgtggttacatagtaggtatatatatttacagggtacacaagatgttttttgatacaggcatgcaatgtgtaataatcacatggaaatggagtatccatcccctcaagcatttatcctttgtgttacaaaccatccaattacattctcttagttatttttaaatgtgcaattaaattattattgactatagattaatctgcataggctcatacactatgatgcactacttttacctccaggagtatctcctaaagaaaattacagattcagaaaacattattcacaaaaatataaattgtatataatttataatatcaatgctgtgtgcaggtaaacaatctaaatcttaaacaataagaaaaagttatgacgtatttaaaataatacatatattttatataaaatatataataccatggaaattttcaatgttagatttaaaagaacaagtacactttgaatataaacctacacaaaacaggaaaatatgaacagtgattgaacagtgattgactttgagtgataaaactcagtgatttttttttccccttctttccagtttcctatattttccaggtcttctataataattatataatattttataagcacataattccctgtattaagtctctttctacttagaaaattcctgatgaatacatttgggttccagtttgttggtttggttttgttttgtttattttctcctgacacatagtcactggcgtttattgagtacttacaatattccaggcactgttttgctgtgtggtcttaggcaaatttcttaaactttctgaccttcattttcctcatttgtaagtaagaataattttcatcatctataaaatgaggattaaataagttaatacatgaatacacccaagaatcatgtctgacaatatcataagcactcagcacatatagacacatttattattatgtccatatattactttgtcatattttgctgcttatgctgttggttctttgcatccaagaatctaagacgcatttttggtccccttaatactttcttttatagattttaaaccaagacaattcttacatggttcttttccttttcatgatttaatagcattgtcaagaaatggggcaatgccttgagaggacacatctttagcaggtcaattttatcaacaagggcagacagcccatttcctgcatatttccttctatattgcagtacaagaatattattaagaacggggagtttccgtagccttgggaataggaccaattcccagatatttaatttagttctggtctcatctaaattgaaattttgtcatagcatttttctcatagtaactgtttagaggaattcctttccaatttgtttttatttattatgaagtcaggccaaaccacacaggtcttcacggctgttcttgttagcagttattggtgacattattaaatcactaacacacattattttgagattggggaccctatcactcaacccatgtagtgtcctctcccattatttggataaattcttctgaaaaaaactgaagaaaaataatacggccattagcatgcatgagtcagatacttttaaactggaaagcaatgcagcaatgaaagtactttcaggaagggaagagaagagattttattgctcccatatgatatctgtgctgctgtatggcacctaagagtttttgtttttcttttttttttatttggagacagagtcttgctctgtcccgcaggttggcgctatggatatcggctcactgcaacctccgcctccctggttcaagcaattatcctgcctcagcctcccgagtagctgggactaggcgaacgccgctacgcccggctaattttttgtattttagtagagacagggtttcactgtgttgctcaggcttgtctgtagttcctgagctcaggccatccgcccgcctcagcctcccaaagtgctagggttacaggagtgagccaccacgcccggcctattttttggtttctttttctgagacagggtctcgccctgttgcccaggctgaatcacgcgacctcagctcactgcaacctcagcctcccgggttcagattctcatgtctcagcctcctgtgtagctgggactacaggcacacaccaccacgccctgctaatttttgtatttttagtagagacagggtttcgccaagttggccaggtagatctcgaactcctgacctcaggtgatccgccagcctcgacctcccaaagtgctgagattacagacatgagccaccacacctggccgtttttgtttgttttttgtctctcctgaattatatacttttctttactagctaaagattaatttttccttttctcagaaatcctggctttgattttttaaattactttggaatttttaaaaatagctccaaagctccaaatgaatctgtaagtcccttaagttcagtggtgggttctatgcagcttggtgatttatacatgcagcattgggttttactgggggcctgtgacttccccttactaataatttccttgatgtggctcatattcacttacaatcatttaggtccacagttctcattcctcattctggttttgtcttagaaaaacaagtaacagaaaatgattatttttatgggaaaaaaattactcttagtcccagtttttagagatgatcgtggatatggtttggctctgggtccccacccaaatctcatgtcaaattataatccccaatgttggaggtagggcctggtaagaggtgactgaatcttagaggtggatttttcatgaatggtttagcacgatgccttggtgctgttctcatgatggtgagatctcatgggttgtttcaaagtgtgtagcaccttccacctcactctctctctcttgcttctactctggccacgtgatgtgtgtgcacctgcttcaccttctgctgtgattaagtttcctgaggcttccctagccatgcttcttatatagcctatggaactatgagccaattaaacctcttttctttataaatttcccagtctccagtacttctttatagcaaggcaagaacagactaatagtaagtcattaagtcaaatcatctcccaaaaggttacttatccaagctatgaatgtgcacgtacatgtaaaaataaccagcggttaacagtaaaacagtttaaaaactatataacctgatgtttggcaaaaaacaataagaaggtggtgaagtagttggagatttgtgaaatttatgaatgggatttttcctctaaaggctttagagagaaaaatcataaatatactggttctttttatcatttttctttgttaaactaattttaaagtagtttcttcatatctcaagacaatcttgtaaaatgttcatttctgacagtcttaaagattaaagggactactgaaagataagaagtgagttttcttagaagaatgggaagaagataagatatttaatagatacattggtaaatatgggggattagctaagataattaagttgaatgttattcagctccctgatatctgatatgattgataatgaaaggaaggctaagagcgggcagagatctcaatagtcactagatgcaaagagcagaccacacagctaagatgagaagagatgaggcatgcagggaagaactggcacagacatatgcaagtctgatgttaagtactctatagtcacatagatttagactggaagctgagaagttttcaaacaagctattcttgactaatctatgctgcagtggggggaaaaattacaagttcaggaggtttttcttgttaataactttggtcccgacactttgatgtctatgcatgctatttgcttattttgatagctactatgttctatattgaaagcatttgtcattgtcaatactcagacttttctttctgtgtagaatattgggtatttagtggattgggaagagttatttgggggaatttttaatagcagatagttctcaaaatttttgctggagatttcctccacattcaaccaaaatttatctatatatacattttacaaaaagagtcaaaaggacgttaaaactgagtagacacccttgtgtactgttgctgggaatgtaaaatggtgcagtcactatgaaaaatagtatagtggttcctcaaaaaattaacaatagaactaccatttgatccagatattccacttctgcgtatatgccaaaacaacaactgaaagcaatctcttgaagagatatttgtacacccgtgtttgtagcagcattatccacaatagccaaaggtgaaagcaaccaaaatgcccaccaactgatgaatggataaacaacacgtggtatataaatacaatggaatattcattcagccttaaaagaaagataattctgacacatactacaacatggatgaaccttgaggacattgcactgagacaagtaggccagtcacataaagaaaacctgtatgataccacagatatgagttatctggagtagtcaaacttataaaagcagaaggtataatggtggttgcctgaagctgggggggagagagaaatggggagttgttgtaagggttttagttttgcaaaatgaaaaagttatggagggtaattgcacaacaatgtgaatatgcttaacactactgaacacttaaaaatgattaagaaggcgaattttatattacatgtattttactgcaatttttttgacaacaacaaagaaaaactgaatgggtgaaatgaagaagtgatctaaaataagttagagatttgttctcctatatcaacattgacaattcaaatgttatctgtgtagagtttttttctttaaaagactacattatgtggtatattctcctagaattaaactactttgtaacatttactgagtaaagccttaatagtatctttggcaaaattcttaaatatttttagggtcaaatagtagaatactgaaccaccaactttgtgtaatgctgatggtaagatatttacatttgggcatttgaactgaattatcaagtactttgcacaaataaagtttgtaatctatatagcctattttttttgcaatacatagaaagtttaaatttaataaaagtactgaatgattaaaaatcagagacatttccattgttatgaaaattgattgattatggtaagttcaaaacagcaacagtatttcatagacagacctctgagttttaaccattttctgtttacatctttcttctcctttgaggtaaaagttatgtcatcggaaaaaaaaagatatagataaaataatttagaattatagttaattttatattccccgatttggagaaaatacaaaattcttattctagattcatctaaacagaacaattataaactataaattctactcagattacttcattttcatttaatctcggaagatctttaattacaactatttttgaaaaatataaaatacttaggaaaaaatatataattgaaacatcagacaaaaccagttcttaaatagttcttaagaaaatactgtggaaagggaaaaataaaattcaaatatttcctttctaactgagtatgcattaccttttcaaaattgaaataatgaagtaatgaacgtgcaaatcaaatttgtaattaattagctgaagtaaaagcttcattgcagatatgctacattttttgcataggtgttgtttagcctattaccaaaatgccaaaatattttgtgtaaaataatctattatttgcctcttcccaaatgcattctaagagtagatgctctataaatacataagatgacaaaacaaataaatcttttaactatagctctctctctccccctacctcttacacattgtcttttttctgaaaaaggtcttaacttctttatgcatggtggcaccaataatctttttttcatttcagggaccttatctataaggtattgcccacataactttgatatatgagccttttatagaaagaagaacacacccatgcacaatcctaaacctgggaaaaagctttccacaaggcacacagggcactaggtctggggctgtttactactccataaggggccatgccatggtgaatacataggtgctgtgttctagatgaagacttggtgttttgtttcttttttgtttctaatattttctccagaactattatacattcaaagctatcctgaaaatatatacagttgccccttgaacaacaggggtttgaactgtgcaggtccccttatgcatggattttcttctgtctctgccacccctgagacagcaagaccaactcctcttcttcttccttctcctcagcctacccaacatgatgataaggatgatgaccttcatgatgatccacttccatttaataaacagcaaatatattttcccactgaattggttgccatgtttcttaagtgtctcttaatattcaggattccctttccacttctttttatccttataatttatttattgaaaaaaatcaagcccttggtcctgaggaatttcccatcgtttggattttgccaattgtattcctgctgtgtcctttaatatattctccaatccctttatatcccataaatctgtagttatgtggcaggccaagtattaccagcagctgaacaggcaggcctccataacaacagtttcagcactagctgagtggttaggttaaatattaaagctgaaagagccagtgcttttatacaaaggctggaatgtaacaaaagcccaccaagagttttgcctaggcctttcttgggccttgaagcacgacaagataataaaagaattcttaacaggacctgtttaggattaaacaagtttttattgggggtctgaagaaactccccagacctccacaaacaagttgtattgagagtctaaaggaactcttcaaacttccatgatttaacaggagacaagataagggggccgggcgcagtggctcacacctgtaatcccagcactttgggaggccaaggtgagtgtatcacttgaggtcaggagtttgagaccagcctgcccaacatgttgaaaccccatctctactaaaaataaaataaaataaaattagccaggcatggtggtgcatggttgtagtcccagctacttgggaggctaaggcaggagaatcgcttgaacctgggaggtggaggctgcagtgagctgagatcacaccactacacaacagagtgagactccgtctcaaaaaaacaaacaaacaaacaaacaacaacaacaacaacaaaaacgagtaatcacccctggcacctggaactatctagattaagtaaatttactgaagttccagaggaaggtcttcaaaattcagaccttagttatagattagaagaagttaatgacttacgtttttagacgaatgcacactgacatgtagacatatagctcagatggtatataagctctgaaaaactttgtaattttgagttggtctggcaatattttctaggcctggttacagattgtacccaattacaggaataaactctcttctttcccagttcatctgcatctcgttattgggcagaaagaataaacagcctgatccttggactgttctgagaacagttatacctaaagctggggtccccaacccctaggcagcggaccagtacccatgtgtggcctgttaggaacctggccacagcaggaggcgagcagcaggtgagtaaggattaccacctgagctctgcctcctgtcagatcagcagtgccattagattctgataggagccaaactctattgtgaactacacatgtgagggatctagattttgcgctccttatgagaatctaatgcctggtgatctgaggtaaaatagtctcatcccgaaaccatccctccccagcccccatggaaaaattgtcttccatgtaactggcccctggtgccaaaaagtttggggaccacttatctaaagaaatgattaaattcagattcaatgcatttgacaagaatacttcataggtggtgatgtgtcttcctatcaggaaacacataataagtgatcatcactctttgtgtgatgttataagcctgtaatggtttgatccattaattcattaggagttgcaaaagggtgacattctaattctttttttctttttatattagcaaaaaatatattttatctatttatttttttcccagctatttcccaaataacttatgatgctttgcatattcaaggaatacaaataagacatccagagatagaaccagctgaaatcatactagaagcaattaaacatggtttcaataattctgttcctttcttagatggacttttttgtgctccagagataattgtgaaatgcctatagtcaaatgctatcaaaagggactgatttagtgtgttctactaggacacgaagagattgacaattttctggaatttaactagagacttaaaatatttatgtttctccagtgtaaagaatatagaaaatgtctttataggcctgctaagtagaaagttatccttaacatttccacttgcagtcaaaatatatacatgacatatgccaagtagattaaaaaaatttaagaatatcttatattctttagttgtaaagtattgcccctatcactctggtaaaaacctcaaaatacccagaataagagttgcacttaatagtacattcttgttgtgtaaggattaaccagcaaattttagatatgtttgtttctgtgtatttataatccattacatttcagaactcatagctaagtatcacccgtaataactagcgtatattctacatgatcttatggcaatcagccaacaccaatgtataaacatcaaagaaatttcctcaccataggtatgtacttaaacatagaaatccatatctccagatcaatagtgtatcctggcccctcttgctctctccttgagatgtaaattaggaaattcaaatgaaacagaaagaactaagcaactagtggctgggcctccataccagctgctgagcctggggcagcggttggcatgacctttagtgagtcttccacttagcaatgtcctggccaggctctctaatactgatggtcactagcttgtcagccctctcgggaacaatccctcaaagctttctaaactgtgactgcatttttctgacataataagcataacttattgaacagatttaaatctttgatgaactaacagtgcttcagtcattattctgacattagtggcagtctcatagacagtgaactgtacaagatcagatggatcccatagtgaccagagaaaatgcccttgagtttgttttttgactagccctgtggtacatattcactttattttgatttgtctctttcaaaagtgagacatagccaaggaaaacaccaaaataccaaccaatgggatgcttttaaaaggaaaaactaaggatttgaggggactgaatctactcagtaagtaaaatatcacgagggaaattatagaattagaaaactagaaggaataattgagatgagccagtcatacacccttcatcttatagctgaggaaaatgaggtcatatggtgtgaaatgacttacccaaagtcacgcagccagtcagcaacaggactaggactcatgtctttgactcttctgactatgcaaattgctgaaggttagtatttttggtgtttagttgcttccctaaacactaaattcactaatgaatggttattctccatataaatttatggcacatgagtaaaatctctgaaaaaaaggaggaaaatacattctacaaaactgctaaatttggtattcacagtaacatgatgtcaaaatttcattggaatacaactttttatctcattattccctcacagtgatacaataagccctggcaaaaactgctatttttgaagttgtattcatttttccatatcatcaggatatacgggtgctcagtggattttaacagtaatttattcactggttgtctggaccatggaccaaaaaaattatacagagttttgcaaatgtctcaaagtcactaggcagatctgcctggcttataaataaaaccccgtaaatttccttggtgttatttaaaattaaagaagttcaaaagtgatcttcaaaaatgcaatacttgaattaaaataatagaaaattatatttaaaatcatgttaataatattttagaaatgaatctaaaccctctccagagaacccttgactaaaatatggtcttttgtctgacatttgcttcaaaataagagaaatggggggagtaaattggcaaatagatggggcgcaactgaccatgggttaatggctgttggggctggatgaaggatattttttaaaatcggagtaatagtatctaattttatgtatgttcaaaattctccataataaaagttttaaaataagaaaaagagaaaaatgaatctgaactctgttcatactaaagaaaggcaaaatatttttaatttaaagccatttctaccatcttcagtaaatcccttgtatgagagttgaatttgctaattagactgatgatacctgccttcatcatgagttataggtaattggatgttacaatgaactactaagagagaaaggacccctcaaagtgcagtcaactagatcattatctgaggcagagcaagctaattatcaccataaatttcaaactagaagaactgatctaaacatctaatggacactattgaagggtcaaaccccttatgcttagtgaattcacactaaacaatctttttagtaaattaaaatgggctttgatatacgaaaaatatgcagtatcagaaaatgtgtacagaaaaataaaaaacatgtagagacagccctcactgagttctagagaatttcttataaaccaaagaatacaaaagtctaaatccaaagttgggacaaccattctcaggtgacttaaccctttgactctcactttggaagacctgggaagttagaatattctagaacaactccctgtaatggagctataggaaattactcatttctcctcctctctcccaagagaggcccctttagtccttgggtgtcagggaggaaaaatgtaaatgcatcttgaaatgctgaggtgatactcatagtgtgacatttgacatatgaatagtgaagggaaaaacatattttagtgggcctaacaaatattgatgatctgtgtttagtccccagtgactgttgagacactatttccatgagacaatatcttttgtggtccaaaaaaccgatttacaattaaacatatagaatgccacttgtttataaattgatgatatggaaagatttcaatgcctaaataaattacagtaatgagattatacaattttcttaaatatttattattgtgggtaatcctgacagcatgtggccctttcaagacgctgacacataacggcgtccttgtattggtcactcatcgcttagtcattgcctttgattgtgcagtggtgtcatttttgtcttctttagtcccctggcaagagagtaaagctacagtcttacacacaggcagtgtgttgtatagccaatagaatctttcttggcagcttgcacacagtggagaagggaggccatcatgttggggagcactgagcagaggggcaggagcaaagaggcacacagtagaacttgcctcctggttgagatagcacaatactgcttatatactcatatttgttagtctgtggcttgccacaacttcttcctttaatttgcaagagatacaagatgatgaattatcaaaatctcaccaggcaaaagaaaattctaaattttttgtcatttgggctcagcattcaaaggcatttcttcagataaaaatgctgtttttattcatacatacaagtgacttactagtcttcgattattggcttaatacataaaagtttgttgaatgaacactgaccagtctcactcaagcctaattcaaagcttgactgtccaccacattctagaagggaaaaacaatcccctaaatcctttatgttttataggtgaggcttttcaggcttcaggagtctgcatgacctactcatatgtatcaccattgtggagctccctcccaggcctactctgattccaaccctggaaaaagagtttgcttttcatagtctgatcttcatatccttgttacttacatgaagaacaaaatagaggggaacatattttgagctaaaacactctcgtggaaaatcccatctgtatttgtttgtttgtttttgtttttgttttttcggagacacagtctcactctattgcccaggctggagtgcagcggtgcgatctcagctcactgcaacctccacctcccgggttcaatcaattctcctgcctcagtctcccaagtatctgggattacaggcacctgccaccacgcctagctaatttttgtatttttagtaaagactgggtttcaccatgtcggtcaggctggtcttgaactcccgaaatcaggtgatccacccacctctgcctcccaaagtgctgagattacaggcatgagccaccatgcccggccccatctgtattcttgtacagtgaaaattagaaagccaaatattgttttcattgacccatttgtgaaacataggacagtcaataaaaagggaaattaagattttataaaactacactagttaataagaagtgagaatgaacctctgtgcacggagaaactccaatacggagtaattctgacatctgttacattggatagcaggaaggaatcacaaatcctacatgaacccctactgctacagatcatgcaaagagacttaataatattgcctttgattgaagacatgaagagaacgtttgaaaagtgaaaaatacagagcatacagcatactaagattccacttcaatgaatactagactatacctgtcagagattccaataaaaccctcataatgtcttagatagggcagaatgaaagcagaggatataaaatatataagtacataaccccggaaaggcagcaaatgctcttatttgacataataagaactgagagcttgatgcattttgtcacagacagtaggaaatattttattctgtgaataaattatccgatttgattttgtttccactatttgtttttaattaggcaggaaacatttccaaatttaaatagctaagaaatatttccgaatctttaataggtaagttccaaacgactgtatagtatttcatctgcagccagtcacctttccacttcaaatcagaagccaggtgttaaactttcttgctagtttgctattaacttctgggggaaaaaatctgtttggttcttgttgatatgacagatatttatctttcctgttgttttacatatattattttcaatacacaaaatactaggcaaagccttgctgtagagagctcttttgttggaaagagcccatttccaggattttcatctgactttacccagcaggaccagagggcagaagcccatctttggagtgttggctaggattacacgctgcagctgtcagccagcagtaactgcataacagacctctggcatgtcagtgacttttgtgttcaaaaaagggcaatatttgcagtttacaaagcattctggaaagtgtaaaatctaaaaatcttactagtatctcccatctagatgaggagacaagaatgttaccccaggattcatcagtcacatactctctatgcacaaacaaccgtgaataattcagctgcaactaatgttttgcgttttttctatgcattctctacttcctacctagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcagtgagtacaggttgctaagcaccatcctgggatgcctcaggggaactgagcggtttgcttctatttagtttgcaatcagcaaacactagaggtcccttctacaagttttccaggggaagccttgaattttatatttaccactgctgaaaacagtttactaggtaactgttttaggcagtattctaggtaatgccataaaattggcattttaaataatatcaacttcaatctaacttacagtttagaaaaggtttcatttatcttagatatcctcctttagtgtagtcacattcactgggtgaacactaaaagaaaaacgtgtcccaaaactcttttataatcctgtagctacagcaagattaaaatacacacacacacacacacacacacacacacacacacacattgaacaagtattacaggattgttaagaaaagaggaaggaaaattattcatccccagaatacagttaaagtagaagcaccttgacattttctaggatttaaaatgccgtttcttttctgttattctctccacttctggcaccatcctatagccctaaatatacagttctttgtatttacatagattccttctaacacagtgcagctgtccaggtgctatgtcttaaatgctcacaatatggctaagctgagggaaagaagattatgtcataacacacttgaactgttagaaacacgaaagaactgaaagtaatttaagctagaaaacatacatgtggttcagttcaagcttcattacttttgttttaaaatgaagtaaaatataaagtccagttgtagataagaaataaattgtcagctcgaaaacaaaaaaaaccctccttttaaaaagttcttggtgcacacagtgtgttctcctttcccactttgctaaatcaacttttattgtaaaaatatccctggccttggaactaaagtcactagcaactgccttcacaatagctgtctcagaaagaacaatttgctattgactactgtgtaggttttcagcaagaaccagcaaagctcccttagtaaaagatgtgaggcgggggggcggggaaatcaattgaaactgtgtaggatttaaaacaggaaataaccagcacccaacaccctccaccacattgcccagccacatacgcctgcacaggtaactgcccagttatcctaatcaactgaatgttttggtgcccctgcagtcagagactcctctgagcctttaattaaaagtaccttgtccaaggacacagcaatttagagcttcatcagcaacagtgagattccctcaaacagaatttgacctatatggtgttgaatactcaaggaagtcagcaaaaggcctaatttatttatgaaccaaagcaaatccctaaatgccaattattgagtctctgattgttcactatgaatctaactaaaaagaagaagatagaaaaaaaaagagtaagagaaacccacaacccacattttctcattaaagtatttcatttcctgtagtcctgatggataagaaatgattcaagctcaggatcactatctttcttattttcctctatcagtgtcttgacacatcatccaaagtgaaaaaacaggcagagccacacagtttcttggctcatttttcaccttgggattatacctgaatttcagtttcccattaagtctgtttgtttgatccctggaaattgaaatgtaggcacaagccttggatgaaaaattagtcatgctgctttcaacctaagctaggacagctggataagagtgaaaaggaaatttgaaggaaaagttgacagttactttaacagacacattctctttgggtcaccttgggactccttgatggtcaaggaacttgtaaatcaacctgattctgaatttgattgaagaaagtcactgaaaccttaatactaaaatacctgcagggatgagagaaaaaatattctggacccagcaacaatggtctcctctgtcaaagacatctctggggaaataccattcagtaaaatattactgaatagaaataccattcagtaaaacccattataaggcttgccctggtaaaaaacaaatgcttagccatcccttggtgcagattaactagaaatggtgctggggggtctcttcatctgctaattaaactaaagtaagacaaagcccacttctagctctctgtggcttaccagggccatgctctaaaatcgcaaccctttccacactccagtatcctgcattccccttcccctgttttattttttccaatctcatttatcacctttgaaacactatataatttagttatttattatgcttattaattgtctttgcttcattcctgaagacagaaatttttgtgatgttattcatcatggtatccccagaacccagaacaagtgactagcacgtagtttctaatcaataaataattgttgaaatatgaaaagaatgactggatggataaatggatggatggatggatggatggatggatggatggatggatggatggatgaacagacagatggaaggatggatggatggatggaaaggcatatagaccgagaggggaaagttttcacaaaattctgtggtttccatcccctgcttcatcagtgtcatcgaaataaagccacttcttattataaccagtaaaaccttatactttttatcccatgcttaagagaaacttctgaagcaaacggacagtttccttactgcaagaactttatccccaacacaaattacatttactccacaatctctggggaaacaaaatatgttatggaaataaccaaacttcgtaactgtgctaaatgatatctgttgtttatttgtttattgtcacatctaaaggtcttccgaataacaagaagttctgcccattagacagcattggtctcttacaataaatattaactaaattcacattcttggaaagaaagatacctcacagatagctattctagctaaaccaaaggatgcaaatgccagtgccctttgccagctgttaatgtcatcacaataaccttagccacacaggaaaggaaggtgttggaactgaaaaaaaaaaaaaatcacctctctgctaccatgagaagcacaatggaacactcgaaaggtcaggtttaaaattggattgttaagcagaggttgcatcttggttgttgctcccaaaagctgcataacccttaacaagttatttaatttccctaatcttacctttctcgtacataaattggggatgacaataatagttaccctacagggttgctaagagtattaggaatagcatgagaataaatcactttatagttgttcaagaatttaagagtagcagaagtaatcgcagtagtataatatcacctaatactttttcgaatatgatgagggaagaaaatgtatagctttgatcaacagagtttagcttcaagaacagtggcaaaataggacttggaaaaatctctggcaaacctgagagcaaagaattctatgtatgatctgtcagcatttataggggagcagccaccatgattgttatgaaattagatgctacaaaaaccatgaagttaaatatttactttttggaacctccagaaagcaggccagtattttctcagcaggctccagcagtatgcttgaaagaacacaataactgtttatactctgcacatgttcgattcacgataaaatgacagactggggacaggtcagggcaaaaatgtgacagaggtagagctaaatggacttctgcaagtctctctgggacataactttcttaaaggaaaatacaacaactctaattggacctaatcgctgtcccatcacattaagtccagaattcagagattcctgaaaagggctctaaggaggacagggagccacggctgcaagcattatgcattagtggaggactgtaggcttctctttgctgaaaaatgatagatgacctaggcaggcatgtcatttcctattttgtgctttcatttttcagaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtgagtagcagccaagggaggggccgagggggtgagggcaggtaactcattgcagtgttaaacctgggctcaagaagacaattatctctaacaaaatggaataaaacaggcggcaacaatatgcaaaacatcacagaaaggtcagacctacaccctgtagaaaattacaagctgtatcgaattcatggaacaccccttcttaaactttgctaagcatgaaactgtacagatgaaagaaccaggaaaatgcataaacagaaaatacatagaaaaggaaggcatgttcccttcttagatgctttcttattttcagttgtttctgttcttttgacttttccctaaaggattactgaaaacaactattttgtttttcttttattagaaattgatataaaatatgaaccagtgtttaagcctactttctataccctgttgaaattgtgtacctataacggaagcgtgctcctaagcaggtgttcccacaactgaaacatggggaattcaatcaaagtgatatacccagagtcaattatctttgataatcctgcccctaatttaagtacatcctgtacagagaagaatgtacagcaatgatctaatgattaatttctaccaaacgacatcctgttttttcagtgtggacataagaagtatgcatttaaagaaaaagaaaaaatatgtatagtttagtttgacagactatcaagacctttcatagtgaatggtaaactttttccaacagttagcccagagattatccaaggtatactatatatctattccttatactgcaccctttgatatcattaaaattgttattttaaaactattatatatgtttttcttagtacaagaaaaatgtctgtgatcaaggctttgcacactctgagtccatttaaaatgcattaaaaatatcgtcttttcatcaataatatgggccataaaagtttgcagtaaagaagctactgagtacgaaaaccacttccttgacactaacagtttaaattacaatcaacatttcataatgatcaggaaaatatttcctacacttctagtctttagaaaaatgaactcctggggaagcaaagggaatttcagaagacgttagcctgataccacgcgagagaagtcgtttcttttgtaaaatgaagcgctctcattaaatatccagagcttctggagttcagcctcttttgacgtgatacttactggagagtttttgaaaagaaataataaaggacctttgttacttcctcaaatgctttggccaaaatttcatgggtattcaaaactactagaaaatctttttagtaatctaagcaaagtgtttctaataagcatttgaagtgagcttagctgagagatgttcttcagacttctctgaaggcaaccatctgaaagtcttgacagaggggcttaaggtgggacgagtgacaaggttgtgaggtgatgcatatgttaattagcttgatttagccattcgacaatatgtacgtatttcaaaacatcatgttgtacatcataaatatatacaacttttatatgtcagtttaaaatatagatgagaaaagaaaataaatttaaaacgttttaaatgtaaaaatttttaaaacatgcgtgtggagaggagtacaaaagggccttaaccgtggtagaactgttattaggtgctggcccacagcagaagagccacagttcggccgctatgatgtgaaagtacacattttaagggctagaactcacccaggctggctttccaaataccgtgatagtgactggttataatgacctttactttatttgcactgtgatagcagagtaggggtcctgcttcctgaaacagtaggatcaaaatgccgtcagaggaatctgcagtggagacagttataaaagtattctcagtgcctgcactgacagtcaacatttttgtcaggctgactctgactatggctattacaatatcaagcaccttgcttaaccacagagctggcagaattggtaactttcagaactaggttacctcttgtttctgtcccctacgtaggtggttgttgaactgtcaaaatttgcattcatctattgcatattactatctttctgccttaagtcttattgattcctaggaatgtggacactttagcctcttgtaataaatgtaacttgcaggaggtgtccactttgatcttataaaccgtgtttgccttcctgataataaaagaatggttacccaagcagctctgagcagcgtatcggcaatttcattatcacggcagtcacctgaatgtgctcataaacagacaagctttaggctaaaacttgcttctctagctgtaaagctttaaggtacacagaacgaaggcagtctatctatacagctttcttatagtcttccacatttcaagaggctgccgccaaagtgtatggttttctgtgggaagacagggagaggaggctgaaaggctaggaagaagggaaacaaagaagaatgtgcaaacgtatctcaaaccccagtatttttcatacaataaggatgcaaaaattatctttctgtagcaagtttatcaaatgtcttaagtgacaagatttgaattatctaatttattctgccattacttgaattttcagtgactattatagcagtgattatagcagtgttttccaacctgaaaattctgtgaaattagtggggcattaacagtatttaattattaattaattggattgaattcaattgaaaattttagaatgttatactaatgggtaggtataagtgtcatttctcaaatattcaatttcagttataaggcatatatgaacctgatgtggtataaactgtatttcttcacatagactacacagtcaaagtggtcatcatgtaccaactttctaaactaggaatcaaggccttcaacaatctgactagaaaaggaaaactcatggataactttgagcattaagaaaatatttactgatatttacaaagggatcctgtttttcaacaaactgctactagaatataagagaaaaggcagcattcatgattcaaattattatatggtggtcataattcctgttggattggatacatttaagaaatattttggctgggcacggtggccgcgcctgtattcccagcattttgggaggctgaagtgggtggatcatttgaggtcaggagttcaagaccagcctgttcaatacagtgaaaccccgcctttactaaaaatacaacaattagccgggcatggtggtgggtgcctgtagtcccaagctacttaggaggctgaggcaggagaattgcttgaacccgggaggcagaggttgcagtgagcagagattgcaccactgtacttcagcctgagaaacagccagactccgtctccaaaaaaaaaaaaaaaaagaaaggaagaaatattttggggccaggaacagtcactcacacctgtaatcccagcactttgggagaccaaggcaggcagattgcttgagcccaggagtttgagacgagcctgggcaacatagcaaaaccctgtctctacgaaaaaaatatatacatatatagtggggcatggtggtgcacgcctgtagtcccagctacttgggaagctgaggtgggaggatcacctaagcctaagaagttgaggtttcagtgagccatgatcacaccactgcattcaacctgggtgagaccctattgcaaaaaaaaaaagttgaattaaaataaacaagaaatattttgggttattattaaggaagaaaccagaatgttccctctttctggtggcttttatcatgatgtaatgctttgaggaaattcttgttattcatggcttttagaaggttttctcatgactggtccatcttgaattcagggcacttagcaatgaaagacttttctgtgtgacaaaacataatatgctccttcagccatgatgacaaagagaaagatgttcatttgctttctaaaagtttagagtgggccctaagaaattatcttgtccaaattcccttcaatgtgagcaaccactaaacaatgtccaagacaggcatccaacctctgcagtaactcatctttaaagtaaatttcctacctcaaaagatagtcgtttctgttagacttattgacagaaatgttttcccttgtatgaagaaaattctgccttcctgatcccaaattgtcctacttgagatacgaggaatatctaattggtctttaatgacagagctattagaaatatttgagaatagttgccatgcctatactgcccaagagggaaaacaacaaaacatttttcttttccaggctacatattttcagttctatcaccatgttttccaggtctactagaatcttgtaaaagttcacactcgttgatgtaatggttcaatacatgtaaattcacttcactgctgccaacgtttctccaacttgtctccaagggcagcatgaaatagtccatccagtatatcaggtacccaggccctaatacatgactctgtcaactataaaaatcaagttaatttctagagaatttatgcaggttcctagctatcatgcttccttttgctaaatagaaataatcgattcagcagtttattcaattttgcaagttgattatatttttcagaatccacctctattctgtctttgtgattgtggagaaattatttttgcactgccagtcttcctcagatagagcttcacaattccttaaagacttctagaactaagagttttaatcaccatcaatggaattcttgcctagacttattagtgagaactgacattctctattttccatctatggtatacatcaatttccaaaatgcttaaaataaatacatatatacagcagcggggaaattcacaggctaaaatcatccttttttttggagacaaagtctcactctgtcacccaggttggagtgcagtgggacaatctcggctcactgcaacctctgcctcctgggttcaagtgattctcctgcctcagcctcctgagtagctgagattacaggagcacgccaccatgcctggctaatttttggatttttagtagagacagggttttgccatgttggtcaggctggtcttgaactcctgacctcatgatctgcccgccttagcctcccaaagtgttgggattacaggcatgagccaccgcacttggccacaatcatccattttattctctcagaaaccactatgttccacagacatatcagtttgaattcagtaattcctcatccagggccaatatctagccttcaaatgtccctaggcatggatagcaatagccgtgacccattgccaaggacctcaagttaggcacttcagacatgaaagatcctctgacatgggccaaaggtgagatccttatgagctggttctgcagtccagaagtgtgaggcatagcccatgctaaaatggggaaaattctacctctttgctacagagagttgtaacactgtcacatgaaagtggaatgctttctatagatttactgatagtaccttccattgttcttccaaggcacacagtgcagaacttgcagactctctttcttgtataagaatgtgagaaagtactgataacaacaccgtgtgaaagtcagtggttcttaggcaacaaatataactttctgctaaatttaggcttagaataaaatcagaaaaaagtacaaataatcataaattcatcaagctagaaaaaaccatagagacaattcaacttatttttacaaaaaaggaaacctaagctatacagtctaaatgacttacccagtgtcaccactagctaacttaacagctactactagaatctggggttgctgactcatcattccatgttagtctttctttcacacgtgatgaaggggaaattaacagttgttaaatgtctactgctatgggtcaggcactttgctaggaaatttacatatcttctaacccatttaatccttatttcaagcctatgaaatatgtaatttttacaaatgagatgattcaggctcatagaggttaagcagttttcctaagtttacacagcaaataggagtaagaaagcagagctaagaattcccacgattccatggagattttcacctcccattctacttagagaagacacattctctagtggttaaggaataatcatactcaaatagggaaaaaaccttcagagagtacaattacttcttccctaaaacacgacaatgcagctggtaagtgaatatcgcaaagccaaaacatcactgacctttaccagtccttacagcaagtcttatttcaaaacacgttcaggacactgggtcaaacaaaatcactccaggtctgcctcacacagatagacttgtgcctgcacaagggtgcccagtggagagtgtgagtaaggctaagatcaagcctctgttcataaagccgtggacccaggcttgggttgactaatgtggaggaagaggggctccttctccttggtgggcatagaagcttcactttattaacacaaaggagataacaacagattgaggatcaacttacttgatgcctagaataaactattagcttttatcagaaccttattgatggcactaattgaccttcaaaattttagcatcccacttgggttaaatttcattgagggttagggttaccttaacctattcaaaatttgaaagtaaagataatctattttacacaaaactctttccacataagttttgacccaatattagtaattctacatttaatcaaaatcagtaaagcatgaaattgatttcccacagaaaaatggactggtcaaactgagaatttaatatagaatataagcttagaaggataactttgggggttttctccactttcacctctaagtttaattagatactgttcattctcccttttattctctcccatccctattaggacaactccagagcctggaatatccatttggtagagtgggagaactttgttcattccctgcttctcaagtcaagtcaatattctcacaaattttgcatgatctccatgcaattgctacaaatcttcctccttttctcctcaaaaaatcaaattgatgcataaaaataccaaaagatgtgctccttgacctcagcctccaaccacataattctctatgattgaggtttcaaaactgaagtttcaaacatttgagggattagattagaatctatgttcatcagtttagtctaaagacaagttccaggagagttaactaggtcttcagctctccacaaccacaaccacagatcttgccggaacttctcattattccagaagcccctcaattaaactggccaaagaatctatttcatgaaacctatgtagtatgtaatacgaaaactaacatctgtttagcacttcaccgtatgtaaagccctcactatattatctaattaactctatgtaataatcccttcaaatgggttaaagtagatactgtggttttctaattttgcaaatagagtgagaaccaaagaaatgaagggactatcgtgatgaataagagacaaaatcaggactcaaatcaatgccttcattcattcattcagatttcaaatcttagctttaatcaatggtctcataggactcaagttaatgccttctttcattcattcagactttgaatcctagggttaatcaataattttcttttactctccttgtaagagaaacttaggcacccgctaagtgaagtagttttgtcaattaatgtttcatagtgagttcataataagagcaggaaaggaaacagattgccttgctccccatactgtgttcttatcattagaccaaactagagctgataggttgaaaatgtcagctttcagttactaatgaagggaaatgtcaacaatgccagcttctggtctgtttataacaagatctaattcaatatttaacaactgcaaaaggacaaaatgtttagggaaaagactgtcaaacttttaaatggtgtcctaatctacagaaggtgagaataaaggagcagaaaatggctcaagtgtttaaaaaactaatcaaaatattgaataagatcaatctcctttgaaagcccagaataaacactcactgaagattttttaaatgtaaagtaaaatagtataacatgggcagagatgttccaaagcaaagttgtaaattacccatctctccttttgaagccccctcccccattgcttggctctggaggcccctggctgccctgagcccccagtctccagggaaatcacatctgacaaagaaattctccgtaaggggtggcaacaatctcttttcctttgtcagggtcagaaatgactgcttctttcttccctctccctatgggtgtgatctttacctcaacaggatgttccctatgactttctccttcatttaacagtgaaaatgacattaataaaattaatccttaaattagcaatccctgttaattattctactgtacctccctgcttttcttcagtttgtcttggtctcttgagatctctgggttcctgggatagcttgggctttgagatctcatctttctggttcctgaccatgtatccagcttcttgaaccactttttttctcactgcgacttctgtaagggccattcaatcataggtagcctggtaggttatgtgcactattttaaaagatggtgagacctgttcatccatcctgaaagaggtgttcactcttgcataccagccactcaggaccatggtctctctggaactccagaatgcactgctcttctctacccaaaccttacggtgacttttgttctaactatcctctgtgtttctttggtaacatcgcctcttaaattttggacttctgatctcattcttggtcttgcttcactgctgccaggatagacagctcctccgtagtcaggctagggcttgaattcttcatgccaaccacccctagacctccagtaccacccaatagttaaagataaaacagcaccacctaagacatagcaatggctgcctatgtgttgaactgtgaagttcatgaatggattgatgactgtttttcgtaggggtttttttggtccatttacctgttatatcaactattatccactttgttctgcttccccaactggtgtcctgagtctgtctgtctgtctaatgtgtgagggtaatttgctgtgtcccttccctacccttaagatgtgacttgacttcatctcatttattccttagctgggcattttcatgggttctgtcctctaggatataatgccccactctcttctttctggctccccattcttctttaactgaaatcttgctccctttagctaagggagaaacttccatgcacctgtgaaaataactgtcacagcccccttcccagcacctgaagttcagcaatattgactctgccccaataacatgataccagagcatggcagaattaaacagaatgttctgccattcacctactcttcctcctccctccctgcagacagggatataggcccgaggcctatatattagcttcatttcacttcattttctcacccaaagcttcattgctaaaatatcaccttcagctctgctctcctctttgctttccttctcaattcaacaactcttcttttttcctaatcatttcaacatcagtattagaatgtaaactccataagggcagggagctctgctttcttccatttagtcagtgctgtgtcactagcatctagtctctgtgcataaaagacactcaacaatatttattgaatggatgaaataaatattaagattggaagaagtggtcagataaggttgtgtatatttgaaaaagggatgacagtttttcagaaaaggatgctagctgcagagaatgttgtggcaggactgagcacaattatctgtagggtgtgacccacagagcagcctaaatggagcataaattctgataggggagtggtagaaagtaaagaagaaaaggaagaaatgaagaagacagcagaaggcatttatccagtatgtagaaagaacaaagatgataaataaatcttttagaaaaaatagaaggcattcctgaagtcctttacaccatgaatgaaaattaaaatcatttttaaaaccacaacctaggagataacatctttaacaagggggccaggagatgatattgatcttcagttctgtccttttctaacaaataacaagatgctatgagcatcttgtgctgtctagattctagactccacctagagcccaagctgttgggggcaatgggcttcaagagagttcaccaaaaatccatgctcgagagcagggctgggaagggccagtgggcttgttggcgagtataatcttagaactcatatgtgtagactatgcccttagaatgggagggcataacaagcctgaacaatatgtatagctctaaagtctagcgaagaaaactaagccttacatgtggtgtgccgttgaagcctgcagtatttatatttaaagaaatgatgaaaactgtaatctgtgtccaggggtcagcgagcagtctctagtcctgaattactctctagtcctgaattactctgttactctgccacagagaaagaacagagttggccacaagggctttcagtcagaacctgacttccatggtatagtgtgtgtgtgtgtgagtgtgtgtgtgtgtgtgtttgtgtgtgtgtgttcatgtgtgtgtgtgcacatatatgttataataataaattgggatcaggttatttatatatatttatattatttatatgtgtatgtgagtatatatattatttatggtgtatgtcaatgtgtctgtgtatgtgtaaattttgcttgtaaattgcttcaaatgtaagttgcttttttaaacaaagtggatacatataaataataggagtgaaaaagaaacaaaatctggctttgagtctatgctgctgtcttctcagtggggctgattttgttcaggatcactcgtggaggtaggtgagattggcttcaggtgagaaggcttcagaaatgagagaattccctatctcaatcctctaacaaagtcagagcaaaactttttaaaaataaaacagtaccgcacatactcccctgatgtaaatagagttgagtgacactagaaaagtaacagactttcatgagcttatatgtgacagaagtcattagtctttactgtttgctgcttggattatttatttggatctaagctcagtatctgaagtgaggctacatccacagaggcactggttttgacaagatcatcactcccgccttcaacaaaataatcaagaaatgactatgatgctaaatcggtgggacaattcttttttcttttttttttttttggttatcttttctttctttctttctttctttctttctttctttctttctttctttctttcttcctttctttcctttttggtctaatacttcttggtatagatccacctggaaatacatttaagagaaagaaatgtctgtttttgtgtcctggagtgccaatgaaaatgagacaaaatggagtcttgcgggagggagggagattatatggcataattcagtggaaaggctgaggccaggctgccagtggaaaggctcgtgctggttggccactccaggttgcaaattctgattcaaaagtgaccttgagggcaccttcccactccagccttcttcactgatggagctcgatggtaacacaaagatgtttgccgtttctgtgtcttcctccagcatgttagcgtgtttttctatcagtgggaactaggttggaagccccagactctgcccagatcctgcttctgggattgaggtgagccagggcaggagagcaggagcttaggatctcccagcctgcactggattggtgggaaaactcatccaaggccttctagaagtggtacacaaagggagaaattgagcaaagtggtggataaggtaaaagtacacatgagagaaagaatgattacatcacaagccacaaaaaaaaagaaagcaggtttgaataccatgtaagaggagggaaactgtaggggaaagctgtgcgtagctgagagaactgggatttgcacatacagaagctagtgtgggatcaggccatatttccctcctccccacatttatcccccagccattccaccaatttaaagttaatgaagaatacagcctagctaaatgttttttcctttgcttaacactgctccaagaatttacattttaactttttgtagtaatagaaaccatctcatagatgataattgtagcatatggagcaggtttgaaacatacagttacaactcaagtgggcatgaatgtaacttttttttatctccataaatgagccttgcaaagccctggagtcctgcttccaccgtgagcagcaggctggctcccaacacatttgggcccaggacaagagtgcaaatgaaggctcaggtggcatatggctaagtatttggaagtttataaactgagctagcaaactactgggttctgctctgtcctcctttcttgatcaatataccttcaaaacaacccagagagtagggatgcatggagaattgctccttagcgtccgttcagctgttgcagcacctgcggacaggcaggactgtagcccacagcccacaccttcccttcctaattgttctgtgcctccacagcccatgggcacacacgatgcaggtggacaaggaagcccacacatctaattccttctacaaaaatagccatcctttgcccaacccccagccctaaggatataaattccaaaccacgggaaagcagcccatggaaaaagaatcaaataataatggaatgactcaggcatttgaagcaggctcagaatcctttgtgcagggaataatgcagtctggaaaacccagttcacaaaaggtgtgcagcctgtggggatggggggaacgggacatccctttagcctccagactacccatcccgtagggagaggaacatccaaagaagaccagagcacggccctctttcctgaatctcaggtcactggacagcagtgagcccctgatgatctcaccaattaaatgtgtatttcttctgatccagaacttggtctcttatgggtagattctcagtaaattcccaattcaaactcagtcaattcaaaagtctaactccatgccgggattgttttcctttccaaactgctctgctcacctttcctccattctcctccactctcaggatggcatcttgatcatgggccaagtcacagtggggggcaggtgtcatctgatgctttatctttctcagctagcctcagctagtttcagattggatgcagcagacctttcaaaagaggctttgtcctcacttgatagagtgcccacagatgtcatgtctccatctgctctcttgcatggtagggtcactctcccactgactcagctctacttaagttctaagatctggctaaggactagtccaagaggcccggttgcaggcttttactgagccctagctttggtttgttcagccgcaaatctcagagatgagtcccttcaccctgcttcatagtgcaggttctctagctttcaactctcatctggtcccttccctccaacaggcaagaattccaccctttgcgggttacagagaaccaagaggccctatctcagactctgtctgcctaaccacaccatgccactcattctattataatgagcttcctcatgttggcatagagcatgttacttagaggtatctgcaaaccatgaattctagggaggaagtggggacaatccctctatgttctggaatcctaaagctgatctggagtctttgtctccctaccacactccacccaccacaatccattagaactgggccaaaacctcccaactttgatttgttggaaccaacacctcatgttcccgctttcaacaaatcattgctcttgcaaatgaaagctctgtttcttcgatactatgttattttgaaagccaagctgagcagtgactttcctattcttggtggtgcactgccttcctctaaagcaaaagaagcctgagcttccatgggtggaaagccaaatgcaacaagaaaaataaagaagaaaaattttatcaataatactttctttcaaaaatactatctcactatacaagttttttttcactgcattctttaagtggtagagcaaggaataaaaaataagcagccttctgcttgcactttagacattgaaggaagaaaggaaaggcaattctgcttaggaggaaaatacagaggaccaggcatggtggctcacgcctgtaatcccagcactgtgggaggccaagccaggccgatcacctgaggtcaggagttcgagaccagcctggccaacatggtgaaaccccatctctactaaaaatacaaaaattcaccaggcatagtggcaggcacctgtaatcccagctacttgagaggctgaggtgggaaaattacttgaacctgggaagcagaggttgcagtcagccaagattgcatcattgcactctagcctgggtgacagagcaagactccatctcaaaaaaaaaaaaaaaaagaaacaaacaaaaaaaacattgaagtgctctaaccctgactaaaccctccttattttgtcaattgctttccctgcaccccacgtcccacagggagggaaacctgcctgtcatcctatgcctcccctcactcaggggccacagtcagccctgctgtcagggaaggaccatttccatcaaggtattccacaccacatacccagacacaggatcctatgagcctaccagtcttttcttcaaatgtatgatctgatcaccatcatgtgttaaattagcataaaaaaagagaaaaaaacagaataaaccaacagaacctagaagaaacaaagatacttattttaaataatcaaattatcctcatccacaatctagaacagtttctgtgtagaaagggaacaagtacaattctcatgtatttaaaatatgataactaaaagaaaagattcaatggatgaaccaaataatagaaggaaccaggctaaagtccacgctggcaatctggaggagaaagtcaaggaaatccctcatgctataaagcaaaaaagatggaaccaaaatctgggctattttcctagggcttccataacaaagtactacaaactgagaggcttgaagtaagtgaaacttgtctcacagtcctggagggcaagaagtcctaagtcaaggtgtcggcggagctatgcatgctccctctgaaacactggggaaggatctgttccaagcctctcttagcttctccaagctgcatgcattccttggcttgtggaagcatcgctctggtgtactcccgtgccttcacatcctctcccttctgtatgtgtatgagatgcaacctgagaaagaagagttacaacacaggacaaaggcatgcaagatattcgccatccacctacatgcactcttcggagcgcaaaacacagacaggagaggaagagaggcagggttcagatccacaaggatgtcagcagagagcgtgtctgcctgttcctggctggaacttcacacagtgactcctcatggtacctactatttgttggatgaaggaaagagtttggagtcagtattggtagggatactctgggctatatctttctttctacccatcctttggcacctcattgcttcaggttctggaatctgatatccatgtttgagcagcacaatgaaagaagaaggtaaaatatttactagaaagtaaatggggatgcagggcatgggatctgtagtaggaagattcctcttgcctctagaaggagaaaatacaccaaagaacttcaaatgcgtatttagacacaagtgaattggaataacctaaattgcaagtatttattcaccataattgaacattttgcaactcactgtcttttctgaaaacaaaatgcagtagacatagcctttaagtaatagatttctaacttcctgatgtacttccaacctttgcttcttggtatctaaaagtttaactaggcacatcctgcaaactacttcttggctcctgagacataaaattcatcttggtctgatgaatactttcttccagttttatttgagaaattccctagaagatatggataattttaaaagtctgagaaacgaaatcaaaggaaatctaattccacaaagaatgctgagtctaaaaaataaattataattctggaagattgaaataactctttgaaagacaatatccccataagtatacatatatctagaatgtgtattcaaataaattccaccgaaagcctatttttctcatctgaggtcacaccatagcccaaataattttatcttagctaacataatatagtgaatttaaagtaacaactaaaaattcattaagatgaatgcacatagtaaaatagataaagagaatttttcctaaagatgctcttttgttttatacttttgacatggcagagataaaggaattcttatatataatcagggccaaactttacagtttgaaaaaatatatgcgaatggctgatagtaaaaagatgaccaatagagcaaatctttagaaagattctatttttaaattcagaattattgtagaaatctaggccagaatgggactgctattgcttgtgatgctgaagtgagcctaaaatattaaaaacgacagtttactcaaacttttgtttgtgttatactgccactgccaccttctggtaaaaaagtgaattgtttttaaaagaaaacggacaaaaggtcaaaatctttgtttttgcaaaggaggctttaactcctaaattaaaggtaatgtacacagggaatcaagaggaataacatccaggccggatgcccaacgtgtccctagttgagaggtatgaaataaaccctaactgtaaggtcatcaagcagccacaccgtggcattatttataggtgagtagattgattgagaaaatctttctggtctctcctctaactgaactcccatgaagggagtgcactgtcactctccattgtgtaagatgtggggaccagagaaagagatctcagagattctcaagggtaggttaaaaaggtatgtggagataaatgtctggggcctaaagtagatatgaacagaaaacaagattcacaatcaggcgggagcagtagcgcacgcctgtaatcccaacactttgagaggctgaggcaggtagatcacttgaggtcatgagcttgagaccagcctgaccgacatggtgaaaccctgtctctatgaaaatacaaaaattaacagggcatggtggcacatgcttgtaatctcagctactgaggaggctgaggcaagagaaagcttgaacccaggaggcggaggttgcagtgagcggagatcgcaccactgcactccagcctgggtgacagaatgagactccctctcaaaaaaaaaaaaaaaaaaaaaaaaaaaaaaaaagattcagagtcaaaagacacgggcttatttatttaccacgcaaatatatgggtgctggctgttcagtcttggaagctgcagctaatgcagagtggcctagaacccaagcacagtaatagatgaggaaagccttgtctctgctctctgagtggagatgcataaacacccgcaacacaccaggattcaccgagtgtactgcagatgctctgcaaactgctccaaattgatctgcccaaagggactaggtcagaaaaaaattggagaggggcgtcaagaaaagcctcagcgaggtgagatttggactacaccttgaaagatcagcacaaataaagaaaggtggtggagatggggaaagaaagatgacttccagggtaaggaaaccgtgaaagcaccaaggggaaaaatcacaggtttggcaactgacaggaaccggaactggatgtggggtctggctgggtctgaagggccttgctatgacctaagtgtttgtatccctgcaaaattcatatgtcaaagcctaaagccccaacatgatgggatttggcgtcagagcctctagcaagtgatgaagtcatgaaggtagagctctcagggataggattagtgcccttattgagggaataaagagaccagagttcaccttctctctccaccatgtgaagacacaacaagacgtctgcagtctgcaaccccaaatgagggctgtccccagaaccggactgtgctggcaccctgatctccgtcatccagcctccagaactgtcagaaattaatgtctgttgtgtgtaagccaccagctctatggtactttgccagagcagcctgaaccaagagaagccttgagcctcatattttcctctgagtcgggagccatcacagctttcggcaaggataaagccctgcgtggacactagatttgtcatcttgaggaaattgctttacttctgtggaccttgggcttctcggtaaaacaaaatgaagttgcggaaccaagattcacttcttgatctgtctgactccactctctgccacagcaaaaatgctaacatctgcctatctcagatgttgtgtggggatggtgggaagttaattacttactcccagatcatcaacaaagctgaactaggatttcacacagagacagaaagtacgcggttccaccaactggcattcaatgtgtagtagcatgctaaaatattttaaattagaccatcctaatgcttttggagactctaaaggtctttctcatttaacacctgttattatctctaccaggaagaaacccaaatttaatgatctgtgtctgtgataaagtttaaattatcatcattcttcttctaagctgcaaagatgtgtgactaggcaggctcaaaaatttctctccaaagagttgccctttgaagagcagaatgaccttgggccaggccccggtagactggcttcctccatagtgtgtaattcaccccaggagcagacagcctgaggagcaagggggtcagtgggctcacacagcccagtgccagaaaggccagagcctcacacctggaacaactgggccgcggtcttgaatatcacctggacccacctctgtctctcgtctctctctcctatctgggtggcttcatcctcccaggccttgggttttcactagacaggacaaaatcgtggccacaggtggtgcttgtctcaccatctaacagctctgccatcagaaagaaggggcggtgatccccaccagctccagctagaaaaacgtgaagggaagacctatcttgtgcaggcctatgtcacagccacttccacccccatggctctggccaggtgggaagaactgtgattggcagccccacagaaccatatggtgagagtgtgtgtgtgttatgtgtgtgcgcttgggggtggggggtagggagtgttacacactagaacatgggcgttcttccgggatgacccaataataaatatccattgcacctggccgcaagaccagaccataagctaagtatattgcatccagcttatacaagttcttcggtaagccaaatttataaagtgcccactattttcttttctcagtaattctggaaaccttatgttgatagtttgtagaaaaactgcaatttaagggagaaatgataaccatttatcattctgaagatactgctgtgagtggatgccaaagagcccttaagttgaagaaaaactggggaaggcatcttttcttatcattccaacagtgctctagacagggcgaaataaggcaactggaataggtgaaatctgcctacttcacccctccatagctccaataagctgcatctcctggctttcctcctctgctctctgcctttccaaaaccttcattccctcacacttgagctccataagaattaggaacaagggctgatttgaccaaatacccatcatttatagttagtgtgactttaggttatcattctctcctgaagtaagcagctaaccccaactctaatgccccattctgcaataagagaatattattaaaaacagcatttcttgatatcttggagttacagtgaaagtctcaaaactgaagtcagtggatggcaaaaacttctttccacagagagatgctaaatactcaagacagaagggagtagtcaacttccccaacccctcatttacaagaaaagactcccctttgggaggccgagatgggtggatcaactgaggtcaggagttcaagaccagcctggccaacatggtaaaaccccgtctctactaaaaatacaacaaaaatagctgagcgtggtggcgcatgcctgtaatcccagttactcaggaggctgagacgggagaaatgcttgaacccaggagacggaggttgcagtgagctgagattgcactattgcactccagcctgggcaacaagagggaaactccatctcaaaaacaataaaaataaaaataaactcccaagaatcccttaacaagaaggactgacaagaggaaagacatctcactctctgtttggagcctcctgaggtatagagaagtgtggacccaccctgggttacctctggactggaaagtaaaagaaacgctgagaaccatgagagccccacatggcccaggagtttagaaggcctaagtgaagagagaaggtgtctgccctatatgtggagcagtcccaaggctggagtatggatggcgttgcccattacagcgaggtaagcatgggcaatcagggagaagctggtggtttgaccactcatgccactgacaggacaaggcacttcccaataggtcaagagggcagagcaccaagcttgcaatgtctttgaaggactgtgcccgagagaactgcctgccaaggaaagaagaggatgggctgcccttccagcatgggagttgagggaggtggaaccaagagatcagctggacaggaagacatcaatcatgtcagggtggcccctgacaaatgcacccttggagagggccaatatctgggcacctgccatgacagaggaaacccaacagccaagagagatctagaaagagcaccagctaatcaaatggccattggccgctttcctccactgtctccttctctcaccctggaggagcctgaagcaaagcagggagaaatggtgatatgaggagaatgacaaaacaatgttctctatcttcttcatggcttgttcaagaaccatgagtgagaactgtgttgagggtgacagaaagagaaactttaaactgggggaaaattatagtttttattctgattgagatttctgtaatgcctgaagaagacactgttctcctttgaattcatctatacctaaggttctagaacctgctcaagatgtcaccaagaagcaggagaggataagctgaccaaaagtgtttgaaagcagtgacaggagagacacagagcaggttccagcttctgccctaccaaggtcgcacaggtcaataaagtgatgaagctgcactgacaccttccattatgcagtgaaaggctttctcttgataaaggaatttgaaacaaagtgagtgagagggaggagcatgttcacaaaacaaaaagtgctaacaacaacttcccacaacctggcacgagagaactccagctgggaattgctggcacttgagggagacctcgaaggatgaggaggttttggaaaggtggaggaagatgaagctattccaggtatagacaataacatgagcagagtcgcagagacaggtccagagaggaagaatgatctagttttaacagtcttggctccatggggagttcttgtcagtgttaaaaccagaaatacagtgtggagtccacacacggtatgcttaaatctaatctttaaaatgtggattttattctttaaataaaaccatgagaggcttttgggcagcaaaccaccattatactaatggtatctgtgttttaggaaaataactctggtgacagggtgtaccatccggaatagtgagagtagcaagaagccgaatgcactccgattggtcaggaagtgaataccatgtggataccaagagacaaaatcatggctgtggttccagaaatggaaaaagtaagactgagtaagcagataagttagaggtaaggtagacaggactgaccgcagcaatcctcatagacgtgtctctgaatacattactgcggtttgaacattttcccacaggacttccaaagaaattccctcatttcctagggaaacctagagacccccaaaaggccagccatgctctatgatgcccaaagttcagcccggctaatgaagagtgaacctccacctgctgatggggcttttgcaactcggggccactgtttcctcaggggtatggggtcatctctgctgcctggcagggcaatggcagaaacagctctgcctccctctccaagcccccagcagagccagaaaggatctctattccagtcccaatcaggtagacagcagaaggctgaagcagcttattactctgcccacttggttcagcatggcccattcttgcttctacaatagcaggcagaaaagagaaacacctgaaatgtatgttactgtgataagttttcccacctgaagaaaaccctgtgactaccacagccaggaaagagcacgatctcacaagctgtcagctttcacttccctttcacatccagttaaactcctccacagatgtcattacctgggctggggaagtttcctacatattcctcaaaaataatactttatgcagtgccatgctccaaagcatgatttttatcaacctgtgtttggagatgactcccagttacccttacaaaggcttcctatgagttgtggcagttagatcaagttggatacagaagcccagacattctgaagaggaaaaaaatcaatgtaaatacatgtaacttctacataaaatatgcttttacctaattgaaaagtcattatcaattagccaaatgcaactttaatcagacatgaatgattgaggaattctatatttagaagaacacaggttggcatttgaaaaccttcatgtctcatgccattagccttgaaaaccttttgccaggtaactgaggtgtgagttttaattcccagtatcaaaccaagaataaaattattttaattatggtcaactgggtaaggaacattgatgatctaattgccgagctgtaattctgtattctgtccccaggagacacacacctcagccaagtgcttcaataattcattaaagcacttccctgtgcatcaattatcaaatcatgtgccttgattactttacttggggaaagttacccttgcgaaaaagacttttaccaattatcaaaacacagaacctctaacctacattatacgattttcattaaaataatacaaaattctacaatagctctcagttatctatgtgccaaaaacaataggcaaaatggttacaagggccatagcctgaccagctttatacaaaattatgaggtaggtggtttggggttttacctccctaattctggttttgccagtagttcatcataaagaattgtttcaattttctttaaacatcaaaatatttgtggtccaggattagatcgtatcaccttcatattcccatgatgccaaactccatgctttgaatatagagtacatagcagatcatcagtccgctcttttccacaggtcatttgtgactttgatcatccatagttattgttttatatatactgttttacccaaaaattcaaatgaaaaaaaaatatgaaagaaggtaaaaaacagtgaacaaatgtataaataagagtctataaatagaaactaaaaataagatagtctcaaagtgtatttccttagatacatagagaaggcattccataaatatttgttaggtggtaaatcaacaaaaaaattagaagagaataagaggggagaaagcctccattttcagcttagtggccaaagattttgcccttacagccaataaaaaggagtaacattcaatgtgaaatttaacttttcttcctgtactgatccacctccctatgataaaagcaattctaaacagaaaatcactggattaatgatggccagagaaatatagatgaggaaaggacaattcactgattgaataatcaatcctggatagctaaaaactaccttcatggggtttactaactcataataataaaaagcaatgagtatatttatcctctgtaattatttccattaccaacactcttcttgatactgtagttttaggaccaatatgaacactagaattgagcacaaaggtagtgtatctcagtgcaactgttttttattatttttttctgtacctactatggaaaggaatgcctccaaaacaggaacttaatgtagtgcatatttgtcagtgtttgctcgcacagcatggaaacatgatttctatgtttggaaatctaaggtgagggaagtgggggcagttgagagatgggggggcacagatctgagttctgcctcctcccgtcacacctcccacctcccacactgcacttgtgatccagtgattgtgaaggtgatcaggaattttgaatcttgaaaggatggggcatgggcagatgtagacaaagactattcactgtagcagcagcggtgagggtggagtcaagagcccagcaacgtggcaggaagtgtccggtgggcggagtccagacacgcagtgtgtccacagggatgtcccagggtcagctgtcctgccacactgttcttgtgggggtggcagaggagtcttgcccatgacttcaatctcttctttcccacctgcttaccacacacagacaattttgtgagccacctgtggtgcttgtaacaaattccttctctgtttaagttagacagagcggctttcttttgtcttgcaaccaaagtccctgctttgtaggagaataaaatacaatgtttaaaggcataattttctgggaaacgaaacaggtgcaaattcaaaaattagactcaagtttagaaatagcatgctttccccatctttcacccctccctacttacaaaaacttcctctgatgtatataaataactcatataggcaccaaagactccactcgacagcctgtttaccctttgaaaaatactttttgcctaattataataaaaaagtcttaaatttggtatttagataaattcgcaggtaatcaggttaacccatcaccacagggcataaatgaatgagggggagaagaggagaatgccaaattagattatccaactagagcatctgtcaataaatggagggaaggtgaactaatttagagtttgttttattttacagactttaaaaagaccaactggctttttaatttagaggtagtcattccaggttgtcataacagccagagagttcataataaagggactattacagacataagattacgttttgcttcaataaaaaggtgagaaggcacaggggtgaatgtctgcaacccacaccctttgggaggggccccaaggttgcaggtctgagccgaaacccaatatgaatgtagcagttaccgaaggctgccagagttgttatgcctgatatttcatagaggatgtaaatattgaagactgagagactacctgaagtcactaatctaattctcagacaatattaaatctatgtaatgacagttacagccttgaatcctcagatattatgcctatagtatcttaatatcactatgaccttctgcaaggaaactgactaatttaaataaaaattcccttaatgttcctaacagtcttgattaaactgtgagccattataaagtcatggccacatagaggtgtgaagatagtgaaaagtgagtgtgagtgtgtgtaatatctgaagtattatctgaaattgtttttctgaaaatctgcttgagtccaggtttttaagatgccatggtctgatagatttaatcattagtaaaggtctttctacaatacagaattgatatatcttcagtccttacaggagatgagttaagtaaaagttctagcatgcttagtcctaaaatacaatgcctgtttgaaaatgttgaataacctttgaggcaaagagtttgttctaaaacttaaaacttctaaccagagaaaaattatcttttcctcttttgaaaacaggaaggatcttggcaagtggcacaagatccttttgaatgaaacctgaaaagcaaagattctttttatgtgaacatatgcaatttttcaggaagattttaaacaaaacaaatacataatgttgacagtcaaatttctgaagactagttgtcttaccctatagaggtatgatcttaactcaagttccagaggcaaatgcttcaaatattttcaaagttttaaatatttttagcactaaaaataaacacatccacagtaagtcagctgcacaaaaaaaggaaccctgtaaaataaatttaaaagcatccgcaaatgttcctgtttgtttttctctgtactgcccaaattctaaagatatgaaagtatggttaatgatgtattttatctcaaaatgttgagtcactggaactgttataatgttaaggcacttcttaattcctaatcagacggtcatcatatagaaagtctgtaaacactgaatttaaattctatttcaaaattagttttaaattcatcagtggaatcgattgtaggcccttattctcagtctcaagtcttctgagcattcctctttcccttccgccagctgctgggccctgaacagcagttctcatattaggacaagcaaatctggataattctcttctatcattgctaatcctttctctgaaaatttcattatgaccaccatcctgctcaccattcatccattcatttgttgactcacacaccaacatttattgaacagctaatgtgcaaggccactattttagatacttgggaggcaaagataaatgaaagcacaatgaacaggcttagagttcattgtgcagtagcaccatgtatacagaaatgccaatgacacacaatatatagatgtttgaaatggcacaaatgtaactgattcagtgcctggcaaataaatattcctgtgagagacaaagatatgtgctatcgagactgtccttcaatcaggacttgctaccccagctgctgggaggctggaagtggatatccattagctaactgcccttcagggactggctcaacactcttgctcaagacatgccctctccagatcaatccacatccaaagattgattaaaggcatgagcatttatgcccaacacagtgctccctctggggccagcagtccttcaggtgtgcatgaatctcaattctctgcctgctcaatcctgcctcctccaccattctccttccataggtcttcattcctaggatacttcctaaagagacatgctgccacatctgcttccagggaaactcaactggcaacatttcttaaataagtttttaaaataaactctgcccttagctttcttgcatttccatgaagcctcagaaatatgctactggaaatggctgcattaaacagaacattgataatggtaatgataataataatagaatggcgaagatttgacataggatttaccctgtgtcaggcactatttcaagtgttccgtgcatatcgcctcatttaactgttgcaacaattctacaaatcaatactatcgttaatccctttcaactggtaagtagagagaataagacaaatacctagctccaagttcatgcagctactatttggttcccaggcagccccaaagtgtaatctcgtaactactgtattagtccattttcacactgctataaagaaatacccaacaatgggtaatttataaagaaaagaagtttaattgactaactgttccacatggctggggaggcctcagaaaacttacaatcatggtggaaggggaaacaggcatgtcttacacggtggctggagagagagagtgtgtgagtgcacaggaaaaactaccatttataaaaccgttaggtctcatgaaaatccactcactatcgcaagaacagcatgggggaaaccacctccataatccaatcacttccctcccctctacgtgtgcggattacatttccagatgagatttggatggggacacaaagcctgatcgtatcaacccctatcttctgccatttctcttattctctagcatcctaacaaatatcatagcatcattaatacctgccatggaattacacaccttagaaggtcttttagataataacagctgccattcactgagcccgtatcacatgctggctctgttgtgagtccttataacttttacttatggtcatgacatccctgtgagttaggccaggcttggttattcccatttcaccaataagaaaacaggctcacaaggatgaagtgacttactcaagtcagagttcacaagtagcagagatgttctcaaatctagcatttctgtctctaaaacaaagtatctcgaagttatctggatttatttaaactgtacttaatctatgaactatatacttaacctaaaatggcttaaagaatttaccatctttaggatccatcatttttcattgtgccaccttagccactctctaaacacatcagaaatgtagaagacagaatatggccctctgtccattaacacagctatagctatgatctggaactttcttttataaacctagattacttaaacagaattattctctgtattctgtgaagggcttcctgaaggtctactagagcttctgctcaaataaagaggcatcatattctttagtttaagcccaagtgctatgaatgcaccacattttatgtttgattatatattttatgttttaaggcattgatgcaaattctaggaaatcccagttcacaaggtgtaataatatgatgttatatctgtgctttgaagataattttagttttgaaaagaccaccaaggcctttggcccatgagtaattgattaaattcagcaagcagaagtcattcctgtaggtaacataatggactggggagttaggggaaggagggagagtaagagggtttctcatatgtcattttttttttttaatggcagtgaaattacaagaatttttcaccttgggaaatacaaaattataaatttctcctgaccaaaaaaggacccctgaacagttttactataaccaaagtgagccgtgagggaacagcggctccaacacacagtgcacaatgccagcttttggtaacaggaacaaatggacagagaataacgacttccgcaaggcttgctccttgatgggggaaatgcactcactctttgtctctattatgtgctgcctgacaattgttcccagcagtgaaaggcaagctcaccctctgggaatgggttcaaatataaatgactaagagccctgtcaaaggtcctctgtagctgacacccctctcctccacccctcatcccctcaagggcacttcattttcactttattacttttttccctccaagggcagattaaggttcaggaaaaaatgccattataaatggaggttcttgattagaggctaaaatgtctgccctatcttacctcccactcgctttacttctgttctgcctctttccaagattatccttttctgcaattgcagaatcccagtccccagttttgatatttgagagtggcttcggtaatggctgctgtaaggcctctcatgatcgacccctaatgaacatgcacaaaccctggaaagcgttgcttcagtatccatttactctgctctcagcatgacagctgacagcctcctgcactgagggaaagaaaggccatggcttctgaaagccacagtttactttacttttccttccttgtgaaagtcaggttcacccatacaacactcttttccatgctctggtgttctgaaaatagcagtcatttggctttctcgggagagttaaaacaaagaaatcacaatggcaggaggcttgctgttccaaaactttaaaataacaaaaattatggaatgcatcacaaaagaaatgacagatgtccttgaagtgacccctcatgacacagttcaacagccatttaaaaataatggtcaagccaggcacggtggctcacacctgcaatcccaggactttgggaggccaaggcaggcagatcgcttgaagttaggagttcctgaccagcctgggcaccatagtgagaccatgtctctaccaaaaacacaaaaattagccaggcgtggtggtgcacacctgttactccagctatttgggaggctgaggcaggagaatcgcttgaacccggaagggggatgttgcagtgagctgagatcatgtcactgcactccagcctgggtgacaaagtgagactccgtcttgaaaaataaaaataaataaataaaaataatggttgacagcttgaattgggaggagacatagatagaaaagaaatggcttaaattccacaaaataaggttttggctcataccgcgtacattgagccatgttcaacgtgctttctgacagagaaagtaacgttttccacggtgggaagggctgggaaaggcactggctcaactgcgtgttactacagctgacctttgaaatctcaaaatctcttcacctctactatctttctcgattctcacaacaaccttctgaagttggtgactgctgttaatatcttcatttcacagagaaaaaacagtgatgctcagagactaagttattgctcaggcatcgacagctagagagtggcagagctcgagcacaaactcaaatctttttcttccaaagctcatgtgtttttcactcctcacgccggattttagtggcatggcaaattctcagagggtttcaagttaaaattaatttttctttcattatgttaaatctgcttccttataatgcctaaaatgaggaggtctcttttctttggcaggcaaaatggtgaccacgtggttgtcagtgtgttagaattaacattcttttaaatgagaagttgatctaccaaacatgatgtcagttaaacagatgcgcagtgtgacagtgttctcagggtaggtgccacaggtcaattatgcaagcattgcataagcagctcattgttgccagtttctaattagattcatcagggacttattaacctctggaaaaagttacaagttttgcatagaagcaaaatgaaaagaaaaaaagtcctcattcacacaaagtaaaatatgaaggaaaaataaaataaaaataagattctggctgggcgcggtggctcacacctgtaatcccagcactttgggaggccaaggccggcaggtcatgaggtcaagagatagagaccatcctggccaacatggtgaaaccccatctctactaaaaacaaaaacaaaaattagctgggcgtggtggcatgcgccagtagtcactgccactctggagggtgaggcaggagaatcgcttgaacccaggaggcggaggttgcagtgagccaagattgcaccactgcactccagcctggtggcagagcgagtctctgtctcaaaaaaaaaaaaaaaaaagaaaaagaaaaagaaaacagaaaaagattcaccttattcacatactcatgagaatcaattgcgtaaaaaactcctatttcctgggcctcagagacattaatccaatagatctcaggtagattccaggaacacagcattttgtgcactactcttatgtagagagtaccccaaccgcacttagaaatgtactggactgtgggtgggaggacatggggaggaagttggattcctgataaaagctgcaattcagagtttgcaagatgagacaaagttacccttcctgatgccggctttgaatgagagcattgttagcagtaatatataattaagctctgccttcaaaaatcattgagactaataataacttggtagatagtaatttgactagttttcagttttaagtctctacattgcctcttactgtttgtagctagaataaaacttcattaataaagaaattaagtggactgaagtgaacctttatactatttttaaatgatttgtaaaaacaagaaaaaagacttttttttaccatcaagtcagcaaagggattttttttatgttaattctcagtacaggtgaggcaggtaagttcctaattacctgtaggaatgcaaatttgtgtaatgtttaaattgttctggaaagtaatttggaaatgtgtataaaagttttccaaatagtcataacctttggttcataaatataagttctatcctaatgaaaaatgtgcacaaagatttatacacaaataacgtttataacagtgaagtttttgtaacaatctaaatgtccacaattggaagatagatagccaatttgtgatacatttctattaagcatgtcaagttacaaataatcaaatgtatctagtgtccttctcaactgagccctggccccagtagggaagagcatgtgttcctgacatccccagttggaatttggaatgcattttcctaaagaaaatcatactataaatagtcaatgtgtttgcaggccaactaccagaagcctatttaaccaaaaagcttaaaactttaggaggaacatgaaccttagaaaatataatagtgctatttcaacatcaaatccaaaaatattataattattacttgaaaaaatacattttcactgctaaacaactgacttataaactggcatcaggaacataatcatctcgttatctgtcttctgtgtacatacacagaacataaccatatgccttttgaatactttccaagataaattctcaaagaattaggacaactgtcaatttaacccccaaatagtattattcaacaataatagcaatagatttttttgtaatatggcaaagaaaaatgaggctatcctgtaaagtggatttcagtttgttgttttaattaagttatcatgtggaattggtagtctagtagcatgagtggacctcagcaatgaacctttcatttgtgaagaatgagttaaaatcattcctattattattgctaatttacagatcaataccacaataatgtatttgttgccatgtacactgcaggcactactgatgaacaggaaagtttaaatcttaatatgtctgataaatttaatctcaaatataattctgactacatgaattttagaagtcttacattgtttataacattacctgagagtaattttattctgtcatacaatatatcaaattttttctttgtttctttctctcgtcctcgctctctttctctctcttcctctccctctccctttgtctctctgcattgttcctgacataggtttttgaggactacacactgaaaacttgtccatgaatatatgtcacaatcacctttttattcattggcatgggaaggcaataaaaaagcgattacattttcttttgcctatagctttaaagcagccacttgacctatggcaaacatgaaccaacctttatttcagaggtttgcaatttcaggggtaaacgtggtgctgcatctcccttgaagactttattaaagagaactctatcacgcttatttgagttcttatcaactatcttggcctcaaatgtatgttttccctttattactcctctttggaactagcaatacattctattccattatagagccctctttttaaaattcatattttcatatttcttccacccaggtagacaaagttaagacacgtgcacaaatgagaaagtttgtactgatcaatttttttgtaaacagaagatgaattttctctgtgtatgcttgtgtgtatatgtttatatatatatttattattattttattctaagtaattccgttgctgaaacatttaatcctactttttctgtttaagttgctatattattcccaaaggttgtgatggatgaatttattcagcagacattcactgtgttcccgtatgggccaggcactatcctaagtattaggaattgggtgagcaaatgagacattctctgccctcattaagttttcagtctaacaaagaagatgaacattcatgtaatcttcacataagtatctttttatattgcctcacttttttgagggtatgaggacatctatgtaaatcagtttccaaacttacaagacatgagggatccctaaactcccagggagagtgcacaactaggggtcttaagattgggttttcacccagctttcttcctctactaaccattaagtatgagagctacttagagctcagtctgagagaccctctatctacatacacctcaccctccccataggcaattgtattatgtacatctagaagctttaatcattatgtatacaaaggtgaaggtgacacccatgtttatgtcttagtccaaaattttttttgaactagatttctttggattggattgacatatcctacaaatgacttggcttcttctcttgggatatctttaaatcatctcaaaagttatgacctatgtctcgtgtacatgaccctgaaaacctgctcctcttccagaagaaatactacttcactgaagcttttcagatctgagcttaaatgtcacctccctagggtagactcatctaagcatccttcctgtcattaccttcttttataacagcccgtgtttccttttcattgacctgtatttattacaagtaataattctatactcgtgtgaatattcatgtaattaacataataatatataaatattttcagaaagctctgagtataatggagctgctattatagcctcaatatttcttagaatagacacttaagaaaaatattagctggatgaatgaatagacaggggaaacgtctcagttatctggattcagacccttctgggaaaagagaagtagttgctggtttctttggctctctgagcaagtttaagacctcatcttgagtcaacaagaagtctggcacagccaagagagttaggggatagctggaaaggatgccactatctaatgcacattaaaagggttatttttaaggttctccaaccttgtcctccaaataactcattctgagaacttctttggactgcaaggcaaaagttactggaaatgatagggagtaagggttcttctccagctgccagtggaaacagatgttagaacttcctggacatggtttgccactctagcagaagctactggaagactgagagcagttaccatctgaaaggagcagccactgtcatttgttttcaacaaacaccacagagagtagctgccagtgagaatcttcatcattaaaatggtcactgaaagtctgcttcagaagccacagctgagggaagccaccaccaagaaatactgttgggtgccatccccatcccctgaaagcaactaaaaggaaaaaacgttaacaagttgaattgggggagataccaagatttcagtccttgtccctatcttagtttatgttattttactattgacctgtaggacaagacagatttcagttctttcaatataatcctctttttgtaaaaggaagacaatttttcaaaggaaacttgatgaagattgagagccaaaatatctgaagaagggctcacattaattctcaggatattgaacaagacactagctcatagaatcccaattgaaggtgcacctcagaaaataacaaaagaaagtgaaaaaatgtctcattcaaaatgagggagaaataatcaaatagactctgagcattagttctgtaaatgtaagactgacttattcaccattgtggcccaagagttcttagaataggctctcaaaaaatgttgaatgaatgaatgaatgaatgggagagtagatggatgaatgagcaaatgaatggcatccatttaccttaagatatattaactaagaatagaaaatatgattcactttaagtaaacacaaataaagtgaatgtgttgaacaagccagctatagtttacaatatgataatatttatttcccccaaataagacactttctatttttctatgtttttaagtttttatgtaataaaacaataatttatcttgtttttaatctacatgcaaaacctagaggtctatcacagagagtttgtcaaactgtttgatttgtcgtgctgacaaggaatcattgaaacaattttttaagaaaaacaggttaggtacagcatgagagtatgtgtgaggctgaggcaacggagaaggaaaccatatgctcactcaggttgtcgagaatctttaacacttggcaaaaatgtcacttaatttcttgctggaaaggtgcgacctcctaaagtctttcctcttcatactacgtgagagcatcttttggaagggaaaccatggattaatcttacttgatctggcatatttgggtttgggagttttttaggcagtcctaaaagcctagaagatgaaaagaatgagggccagcagctgtctacaggacagagcactggacagaagcaaacatggacctcctagccctcacatcaccttactgtgagtctccttggcatcttgtgtaggacaaggtatatttaagattattggtctttcagtattatcttcaagaagagaaaataacaattggccacagggaaatatgattgaattggaggttcataaactttgttagactcaagttaaaagagatcacttatagaaccagtctatagagcaggataactatggattacacttgacaaaggagtccagaatatatagggtaataacttttcttaaaatcctaaaacatatgtgtattagaaagggaaaaacaaactgttttttcttctacattcacgcttatcacggaatacttcaccgcttggtcactaaaatatacgggaatttctcctcaccaacaaccaattctccagtagactccagatgggcgtcctgtgattctactgattctgacactatctacctggagatagcaccagatccaacaggtgaaaagcttagtcccacaagactgtctcccacttcagacaccaatcacaagtcttatgttgtaacctgtacttcctactagccagcaataagttgagaattcccatgaccccttttacgggttctattactttgctagtaaggctcatagatctcagggaaagattttccctatgtttacccatttatcataaaggatattacaaagaatacagctgaacagccaaattaaaagatgtgtagggcaggggacaggggaagaggcagggagcttccatgtcctcaggtgcaccatcttctaagcaccacatgttcagtgattcagaaactctctgaaaccacatggttcaggattttttatggcagtttcatcacataggcatgactcattattaactcaatttccagccccccttccttctccagagaatgggggtggggctgagttttaagtttcaagcttctaatcgtggctcagtctttctggtgaccagcccccattcaagtgttgccctttagaacaaaggaatctactatcacccatgaaatatcaagggatttaaaagctctgtgtcagatgctcctgttcctcaggaaattacacaggtcttaaaagctctgtgtcaggacctgggatcaaagaccaaatattagaacctaagattctcctagcacccttatggctcaggaaattacaagggtttagaagctttgtgccaaaaatcaggggcagattatatatatatgtatgtatgtacttacatatatatatatatacacacacacacatatatatatcacacatatatatcacgcatatatacatatatatatcattatttcacaatatatgactactgtcacaactactcacaaataaagacgtgtgcttcagttcactaactaaaatcaagaaccttctttaaggccaggatcacatatttattataacttggacaggtatggccacaagccatactgtttctgtagcaatgggatcgttgagaatgcacagaagataaaaggaagttgggcaatgacttcattataggatcagtcacaagttggagacaaagaaacccagtttagtttccaaaagggcaaagcatattctggtttgattcacccacattggcatccaaagagactcatcttgtcaggggtagggagagagtgctgggtcacagcaacatgagttctaagtagccccaatatttaaggtgtttagatagtgttcaaatgacaagattctggatgctctgcctgattagaccaggacagcagccagctggtggtagagaggcaaagaaggtttaggtaaccaaggagaaaggacagcaaaatctcaaccccagccaatctgagccatcttcaggttcagggaatactctagtcctagccttggcaagtgtgacagcttcaggattttccacataagaagtgtctaggcattgcccactggttggggacttgtcttaaagctacatttacagagcatattaattacagtaaccctagtagcttctatagtaaaccccaaaacctcagcagctcagcatattcgaagtgttttttcactctaattccaactgagtgtttcaggggcagccttatttgaggggcctacatttgagtcccaggttccttccattttgagactgcatcagcccctgtagcctcagagtgttcatttgtgatagtgaagggaaagatgatgtggtagatcacatggaaaaattagcaggccaagacttggaaatacattacctctgcccacatcccgttgacttaaattcagtcacgatcacaactaagcaagacagtgctaggatagagagtttctgggtgagcagccaccttccagcaataactctacactgtgaaagggggacataagtttttggtgaaaactagcagtcttgcagcattgagtttacctagagtatatgtttattcggggtaagggagatttgacaatgagaagtcagtggatcatagagatagtaagtgataataaaactgttttccggaaaggcaagaacactaatgtgtttatatacataggactattataaatttttgtaggttggatttttcattagcaccttggtattgtaatggagttataggaactaataccatgttgctgataaagaaaccggatcaaaaaaagaatgagtaccaaaaatgatataagtccagttgcacctatcccatgggtgtgttatgataaaccatgatttaaagaagagccaaggaaaaatcacataaaaatatatatactagaggagggagaaaaaattaacacttattgaacaattactttaggttaagtactaagctggacctgtcagttacccagtgctatgtaatccaattttcacaaaattaacgacttaaacaacacccatttattatctcatggtttctgcaggtcaggagtctgagcacatcttaatgggatgccccgcatagggtttcacaaggctgcaatcaagacacaggccaaggttgtagtcccatctgaagctcagctgggaaagtatccatttgcaagcttactcaggttgttgaaagaattcagttctgtgtgactgaaagcttcagctttttctgggtgttagctggtgagcacccacacttccttgccatgaggggtgccccaacatagtcacttgctttcttcagcaagaagagagaaattccagcaagctacataaggctatctgaggtaacatagtcacataatcacatcgtgtacctcctatcaacatcactgtatcctctttaaaacagtctggatggcccacactcatcttcccactatgcagtttgacaaagttgtctttaaggttccaccttcacctctgcatttgggtgtcccaggctttcgtactgattcttgcaaagatggtcatgaatatctgagctctcaggatagcacctcatatttggaggccttaactcttccccaacaacccattcactcatttaactgccttacaaagtgactgactagctaatcagatcaactgaattgtgctaatagcttattgcattctgccactgaggtaacatatttgtattgttgaaagggcattacaagagagaatacctgccagatttatattcctaatataatttttatgtctttgctttatggaaacctgctttccaaagcaggtctgccaaatattctatgtagtattggcaaagtaatttagactcttcataaaatgaggagagaagattcaatgacctctaatatcctctccaactctatgtttttatgtttttgttttattcttttctcagtaacctccaataacttcatacaaggcaattgccaaactgctctccaggcattcaagatccaatgtaatctggcccaaattttccttcctagatgtattcactgcaggtattctatatttaaggcaaactgtcttactcaagtataccacatgcattcactcccagaatgcttctccttttcctcattgcatttccttgtcctacctttcttcaagccaagaggaagactcccctcctcgttgacaccttcccatccactttggcccatatcctactctaaattctggtaactactcaatctccacactcggtgggcctttggtttgtctaagtttcctgtgactatttaattttaagctctttcagcacagaaaatgtctactgtatttttgtatatgtcatagaatataagtataaatagtttgaattcaaaaaaatctttattaagcaaatataaaccaaagaattaaaatggatggtaaatttcagccagctgtgtgagttagaggggaagatgtatggagccttttatgtttttataagaatatacatcattatacattgctgtatgctctcctgacagagacagtttcaacaccctatactcatcctatcagaatagcctaaattttcccatctcccaaaagtcactcctttcaactagaatgtctttccccattctatatccaattgtaaaaaaaaccctctccattcttcaaggccaaactaaatttctccttcttctatgaaaatgttcctgaccttctagttgaaattaactctttctccttgttattgctttttcactttctgttggtgttgtactatagtgagttatatgcctctccaagtcatcgcaactagacggtaaactctttaaaaatgggaagtacttctatcatgtttttcttttgtacctttcagaataccaggacagatcctgctgtaagtagtaggtggtaaaataacagtaggtggcaaaataacagtaggtggtaaaataatatttatgaaattgacttgggaaagatgcctcagtaaatctagaacacatttttacaaaaagtgactgatgccttactgagctttcttctacagacagaatttaaaataatccatcatctaagttcaagcaaagctatgttttatttaaaacaaaaacaaaaagcaaaagaacccacctgaagagagcaaattatgcaagtggaaagctagtcaggatcctgagaactttgaggtgaaaaaaaaaaaaaaagaaacacacagagaatggttttacaaatagttttcctaaaatgtgattcacataccactgtggtgcttaagtttgtctaagtggtagaaatttacagtttttatttttagtattttgtatttattttgattgtaatggaaagatatatatacttaataatagtttcaggggtattttgctcatgatgaaactcaattaatttaagtttaaagaaagaagtaaataataaatagttcaaatcctacgggatgtaataaaagttgtgagaagactacagaaatgactgcagcttgagaaagaatgaccaatttctgtgttctaatcagtcagtcaaggtcatgagagctcattggaacttctgatttctcggttctcctggctgatctcaggccactgtctaaggctctctgaatgtaaatcatagatttccctcaagagttttcagcccttgagtatttgctttttaaaagactggattctatcactggccacattaatacaatttctaccaacaccccagaatttcctcagcatgtaacatttcgtttttgcacagctgtttcccgaggccacgggctcctgttgcaccctggagcttgagtgatgaggattctgtgttgttgctaaagtgcctctcttcttctttagagaggcctggatgtcgatatgcagcaaacgtcccactgtctgtggtgcaatcgacataggtcaacttgtttcgaggctgggtctctgaagggccaggtccaggctgcattttcctcccggttgtccaggccaacgatccacattgtactgcttatgaaggacagttgaccttcaactgtctcttcaagggctatggtttctaaaacaatgccagccatctattgaaaacagcttcatcagttgcattgttatcctcaatgattttcagtttctcatcaacgtagttggtccttcttgctgattcttaaataaatgatgatttactattcttcttctgacaacttgaagattcctgacattatctttatgcaatgagtgactggaacaactcacatctgaaattaaagccagctcaaaagcacaagtcaaatcagaatttgataaaatggacaataaaaaatggtgagaaacagagaaaaattgttttagtataaccttccacatacagcattttttcccacaaaccttcaaattattttcaaacatctcattatatgggtacttattttccagccttttcactttttttgccttcttccctatccatgctttaaaaggaagtaagaaaagacattgcaaattcaagaaaacacaagaagtcagggccataattgcacggcaggaccattattgtttgttgctgttcacttcctagaaacaagaaaacaatctccttctttttgtggactgataaaacatgaaggttcattgactgtggtttctactcttctgtctggctttacaacagcttcaaattaaaagcaggcaggacaaggggataataaagtgtccaacctcatcagctttcagcttttttattctttatggtaaaggggatttcagtgtttctttgtcaagcctatttttaagaaaccactttcacagcttttacaagaaaatgtcactgtgcctctggtgcaggcaagggggaatctaatttcattacagttaagtgcctgactccccattaccctccataatagtgtaacatggtatattataggactttaataaataggaaggatgtgggttgcagcacattttagtagaaaccaaattactttgggccacacatctgcctcctcagttcatcctatttgccactgtttcacaacctaattacaggattttctggaaattgctgtccagcagtaactggatgacctgctttatgtggccgagacaggcagctccaccgacttcagtcttcatcactgtcaccatgtaattgcattggacttccatgttaatccctgaaggcgggaagcaaatgaaatattataattaccttttattcccttgcccctgaagcctggattagggcagtgtgcatccaaaggaaagaagtggggactgcttctaagagtattagcgatggtctgatcaaaagctgaggatggtctcatcttcagcttttggcctgaacacgggccacatcattaaagccctatgtctcatccacttagcaaagtgtgtggcccccatctgtttaatgcaggatcactatgagacacgttggaaagatcctggaaaaaaggcctattttatcaatatgtatgtgcaaggcattggaatttgaaaagacttatctgaaggaaagggataggtgaactaaacttaagaagagaactaacattttcagactattcccctgaaaatataaaagtgcactgctgttctttttgagaaaattgtattggggtcacttaattgacatatctcactaagaatgacctgaattattgaaaaggtacatgaatttaaggctaaagttttctagtcttttttaaaaagtctttaaaatccaatgattctttaatgaatgggataaaagcaattctctgaatttaaattctactcatgagcctgtaaaagatgtaaaaataatcctcaataaagcaaatcttgactttgaggaaggaaatggctctttgctgtgtttcatttaccgtggtaggggtgggttgagtgtaactggagactaatccatggtgacctgttgtccctgattactctgcaggcaatcctttgaaaataccttaaacatggagttcacttaatttctacttccctcctgaagagttctaagctgggacaagagtctgtgtccttgagaagtatctttggagttgcactttatgggaattattgaatagtactcaatttagatataatttcccaaaatgcatttttcaatggcacagcaggaagcatgatgaaaaaggggtgacattccctttaactaggcaactcctccgataatagaaacaacacttctcaattttaaactgctgctttcactgtatgccaactttatcattatgtccagagctgaggacataggaacaaacaaaatggcaatatgtttgtcttcttggagctcatactccagcagaaaatcatgcagaaaagtaaacataacctgcaaaaatgtaagatctgtgagtaaatataaagcaaggtaaggggacagacattacaggcagaggggttgaaggagttattttcaatagggaagtcagaaattcttctctcatatgatatcatttgagcagaaacctgaggcaatggagcaacccatgcaactaacaagaggtagagaaaatccaaagaaaaactttggctgctggcctggcatagtggctcatgcctgtaatctcagcattttgggaggccgaggtgggtggatcacttgaggtcaagagttcaagaccagcctgaccaacgtgaaacctactgtcatggcatagtgttgatgagaaagcactaagtagactaaaatctaagctgtctactgttcctgctcatacacatggtacctactcttcaatgtccagcagcctaacgagctgacccaaaaaaaatggccccactcaaagatgaacaaccagataggaacgtgactgggacttgcagtagataatgcagggaaaagttgtaacaaagacaaatgaaaaatatacattagaaaaactatacccacaaagaaaattaaagatgaacaaacccatctccatgaaatcaaagaaattatggtctcttgaaaaaaaataaacaacaaagtttaaggattcaagaagataatgagtcaacaaaatggaatgaaatgcaagctggagtggtcaggaaaaaaaaaaaaacaatgataaaggaaaagaaaatggggtcaggaatcatattaactacaatttattcattgcaagcaacagaagtggactcaaaccaacttcaacgaaaatggaatttaatgacaagatatggcagagctcccaaggtcaaaggaaagactgaagatcacacaaaggaacagcaagttccagaggccttgttgaaggaaaattattatagttttacctggtgtcacccctgtaataaatgcatgaaaggtgactctctagcttcatccttgttctcatccttgttcaagattcaagattgcaggagattaggtcatgtcctggctcttggttataccaaggcagtacatgaagcgcttcagtataagaagcccatagagatcttttccacatctttgttagaaggtaagaatatattgatttatcatcctccgagacttgcaccaaacaggggagaggaaattccttaaagggaaataatgctgccgttcgttaagtaaatgatagaatgcaaaaaattagtaactatccactataactatccactacagagacaggatagacaggtttgagaaaaaaattaacaggggtagaataaaaagcaaaaaatgaagggcttagcaggaagtagaggccagcaagcgaacaaaacttcatttgtatttacaggcactccccattgcttgcattactgcctgagctccatctcctgtcagatcagcagcagcattagattctcataggagtgtgaaccctattgtgaactgcacattgagggatctaggttgcgtgcaccttctgagaatctaatacctgatgatctgtcattatctcccatcacccccagatgggaccgtctagttgcagaaaaaataagctcaaggctcccactgtttctacattatggtgagccgtataattatttcattatacattacaatgtcataataatagaaataaagtgcacaataaatgtaatgcactcaaatcatccccatacccccttgactttggtctgtgggaaaattatcttccatgaaattggtccctggtgccaaaagttggggaccactgctcaatgatacaaacattgtgttttatgctttataggttctgtgtatacttctgtgttgcacatatattgttcactgatgagattgtaaccaatttgaggacacagactacttctgactcaaatacttatgatctgcagcatattatactaaggaatatagaattcatattttaattttgttcaggagctgaaaattagacagcttttgtttttaagaaaattgagtgcaagcataatgacaaaaactagcatctaattgcttccaaatacattaagaccaaaactggcaagtttaagacagactaaaattggaccttattaatctttatttcacaacaacaaaaaagtacatttattgaggttaaatatccccagccttttacttaaaagaaataacctctatgactcagaacatctgagtcttagatactctaccaaaaagtgctgcaaccagatactctaccaaaaagtgctgagaaaactaggaaaactaataaagattgcatagaaaataaactctatcttactataatgcttataagtgaagtaagagaagatgcttctaaataatatttacgaggaaaatatatatgaaaatgatgcctaaaattgttactaaaatgtagcagctaaaaccaaatcacattaatgatgcttaaatcactggcatcctactcagccattagtacattttataggtgatttttacactgctacttcacaataattacttatcaacttggaaacaatctttccctgataattctggctgtttttgtttaataagtgctatgcttaataagtgcttaagtggatacagaatcccatatggcctcttcctataaatgtcactctgtccatcagcaatattgataagcttgagaaaaacaatctacagctcaaggcatcgtgcttagcttacagaagagaaacttggatgctattttcttttgtcttgtaaaaatgaagactatgttcttcataatgattgataggacatacaaactaatatttagaaacttcatttaacagagaatatattttagaatgcactgggttaggtgagatttgaggataagctggtgagaaataaactttttgtttcatcagtaggttatgcctaaactctcctgtttctggaaaaactttgctgtgtaagggtgttgtctggcttggtttttgcttacatgtgtgtgtgtgtgtgtgtgtgtgtgtgtgtgtgtgttctgtcagtcatttgagcccatttcaaagcatctaccctgaagaaactttcacttccttgattaatccaggtatagatcataaggacttgaataagacaactgtggttaccataatgaaatcagtgtcttgttcagattatataggaagataatcaaggtggagattacatgtaagaatgagcctgggagcatgcctgctgtggattttaactttagctcagtcctaccaatatggtttggctatgtccccacccacatcttatcttgaattacagcacccataattcccacatgtcatgggagggacccagtgggaggtaattgaatcatggaggtggttctttcccatgctgttctcatgatagtgaataagtctcaggacatctcatggttttataacggggagttcccccgtacacactctcttgcctgccaccatgtaagacatgactttgctcctcatttgccttccatcataattgtgaggcctgcccagccatgtggaactgtgagtcaattaaatctctttcctttataaattacccagtctcaggtatgtccttattagcagtgtgagaacagactaatatagtaaattggtaccgatagaatggggtgcttctgaaaagaggccccaaaatgtggaagcgactttggaactgggtaacaggcagaggttggaactgtttggagggctcagaagaatatagaaaaatgtgagaaaatttggaacttcttagagacttggagagctcagaagacaggaagatgtgggaaagattagaacttcctagagacttgttaaatggctttgaccaaaatgctgatagtgatatggacaataaagtccaggttgaggtggtctagaatggagatgaaccacttgttgggaactggagtaaaggtcactcttgctgtgcaaagagactggtggcatttagcccctgccccagaggtctgtggaactttgaacttgagagagattatttagggtatcaggcagaagaaatttctaagcggcaaagtgttcaaaaggaagcagagcataaaagtttggaaaatttgcagcctgacaatgggatagaaaagaaaaacccttgggaggccaagatgggtggattacaaggtcaggagttcaagaccagcctggccaatatggtgaaaacctcatctctatcaaaaatacaaaaaacttaactgggcatggtggcatgcacttgtagtcccagctactcaggaggctgaggcagaagaatcgcttgaaccctggaggtggaggttgcggtgagccaacatcacagtactgcactccagcctgggtgacagagtgagacttcatctcaaaaaaaagaaaaagagaaagaaaaaacccattttctggggagaaattcaagccagcttcagaaatttgcataagtaaccaggagctgaatattaatcaacaagacaacgtggaaaatgtctccagggcatgtcagagaacttcacagcagcacctcccatcacaggcccaggagcctaggaggaaaaaatggtttcctgggctgggcccagggccccctgctatgtgcagcctagggacttggtgccctgcatcccagttgctctagctgtggctaaaaggggccaaggtacagcttgggctatggaaggtacaggccccaagtcttggcagcttccagtggtgttgagcctgcaggtgcacagaagtcaagaactcaggtttggaaacttccacatagatttcagagggtgtatggaaatgcctggatgttcaggcaaaagcttgctgcaggggcagggacctcatggagaacctctgctagggcagtgaaaaagggaaagatgggatcagagaccccacacagagtccccactggggcactacctagtggagctgtgagaagagggccaccgtcctccaggccccagaatggtagatccactcacagcttccaccatgggcctggagaagccacaggcactcaacgccagcctgagaaagcagccaggaagggggctgtaccctgcaaatccacataggcggagctgcccaaggctgtaggagcccatctcttgcatcagtgtgacctgggagtgagacatggagtcaaaggagatcattttggagctttaagatttgactgccccactggatttcagacttgcatggaatctgtagcccctttgttttggccaatttctcccatttggaatggctgtatttacccaatgcctgtacccccattgtatttaggaagtaattaacttgcttttgattttacaggctcagaagagatttgccttgtctcaggtgagactttgaactgtgtacttttgagttaatgctgtgaactgtggacttttgagttaatgctgaaatgagttaagatattgggggaactgttgaaaaggcatgattggtttggaaatatgaggaaatgagatttgggaggagccaggggtggaattatatggtttggctgtgtccccacccaagtctcatcttgaattgtagctcccataattcccatgtgtcataggagggacccagtgggaggtaattgaatcatggtagtgggcctttcccatgctgttctcatgatagtgaataagtctcatgagatctgatggttttataaatgggatgcacacaattcccctgcacatgctccctcttgcctgctgccatgtaagacgtgactttgctcttcctttgctttctgccatgactgtgaggcctccccagccatgtggaactgtgagtcaattaaacctctttccgttataaattacccagtctcaggtatctctctattagcagcatgagaacagactaatacacctaccaacaagctgttgcttcctaacttaagaatcccagcacatgcttccttctcagaccctttcccattcatctgctccttatccccttcctaaaagcacacagtaacccactcatagcattcatcaatgctttctcccctgtcctagccagaatcataaataagtagaatggagctcacctaggaagctgaagaacagcttacagtgttggaaaaaccctaagaaagaagaaatagaataatttgagaagtactagaataatctgtgaaattaatcaagaatgctctgtccctatttagaaggtggcataagaattttcatgtgggtccattctgcttatataacagtttgctgtttcccttggagaagccatgatatctctatttcagtttttttcacttataatatacagtcatctatttttagggctgcttaagataaaatgggaaagtgatgattaacagtatttccagatccttaaaagaaacttagtttaatctattagaaatctcaaagttacatgtgatgttaaggcatatcacatatattagattgggtttatagaatatttgtttcctcttttccttgacatggtctttgatgttctatttctatctttactatgtttgtatatatgcctcttattaaaagtatttaaaattattttggaaggggacaggtgtcaacataaataaagtaaaacttttagataaaggcaaattatcaggggaacaatagccatagagtgtcactgttacaattatagttgcattattggatctgcttgcctgaaaggatttgggttttgttatcttcctagaaaaaaaagaagttgagaaactattaacctttgataacctttacaatattttttcaagtttgccatgtgccaccaagggaacatttccaagcagagcagaaaattcattagacttgagtgtttcaaatatctatatcaaggacaaggacaaaactgctgtcatagagaaaaggctggtgcactagtgcacaataacttcaatttttcttcatctgggtctagtgacccattccgtaaaaatgccaacactgcactatttgatccagaggaactggggtgatgacatcaagataaacgctgtttgttcagaaagtcccatgcacagcaccacaagactacagtcctgataatattcacagtctcattcagtagagtccaaagtgacatctggtttggatgacttttgtggaaattttggctgaagtctttctgtttcccaaaagcaaaaactttaaattaatgggaacagtaaggttaaattaaggtatattttatagtaatcagataatattagacgtttgattaatgaggtgaacaacaactataattgtgatatctttatgtaccaatttagctttgcaaacttttaaaatatacacataaatcactgtttaattattttctaaaaatactttagcccattttatatcacctcctctgtctctgtctcttctcttggcttctgtcacgtgattttgtcctgactttcctcctgtctctctcttctctccctcatgagcctctagtttcctcatgccctggggcctcttctgttctcactccatgtttatcctgggtcttttcatctgattttatgctgatggcttttatgtcaaatcaaacatgccccaaaccgaactcataatctcacctgtttccatgcccgactctcagtttcagggaattgcactgccacctacctgatttccaaagacacaaaccttctaagtgaaaccacattttcaatctctcttttgacttcttgtgatcctatgtgctcacaatctcttggactctttccttcttcccatccttactgccttcaccttggatcaggttctcacccttcccacttggatgcctgtaacagcctcttagccttcccacctaggatacctgttcaggtatcctgctccaaactttgaatcccaaatgtctccctacatagcctctctaaaatagaaatctgattatgccatttccagcttaaacccttcagtaaatcctcgttgattctgggatggtgtgtgtgagtgcatatacgagagagaggaaagaggtggggagaaagagagagagagaaggagaaggagcataggctaggctttggtgtcacactctcttgattcaaatccacacaacaatatgacatcagtcagatcactgaaactctttaacctgagttttttccattgtccagtggggataagaactgtatctaactcatagggcgagttgtgagaatagactgagttaaaacatgcaaagcacttagcccagtgtctggcatatgtttagatgttgattattgttggttattgttacattaccttacaaagtccaaactcctcagcattacacacggtccctccgctcaaccagcctgcacttactgcctcctgacttcacctttgctctggccctcacaccctaagattctgccatgtcctgtggtttctcctacctcttgcagtgaggatgctgctgcgctgtctgaattgccctgccttttccctggccaattccctctcacccttcagggccctaacaagcacatttttctctagaccattttccctgacccacattcctgtctgtagtatgggcttgtgctatgaatttaataattacttcaatcaaaaacttagtgcattctatgtgtcagtcctatggcaaatgagaataaattgatgtctgagaatccagatcttgtcctcagagaggatataggttagagtggaatagcaaatagacaggtgtgtctccaaacttcatggaaatatgtagaagcggtccctcattcagtctttaaaagtctgagaaagctatctggaagaaatggaattttcagaatcttctgagtatgctaatcttgacattcattaatttgttgcccaaagggagaccctcctaagaataaaagagggtgctattaatcattaccctgggcaataagcataaaccaggactgcctaggacaaaaagggtataacatcccccctacttgtagctatgttgtaatgagtatgtctgccaccagtgctataaagtgacaagtctactatggagtgcacttcctgacatagcttagtagatgctaagtaggtgtttgtggttttagaggacagaggtgggacatctgaagacagtcagaaaaccgaagagggctggcaggtctccagagcaagaagaagcctctatccttctgcatcagggcatagcagcatggtggcaggaagaaaaatgagagaggaaaataggcttcctaaacagcagtaaagtgaaatcttcctggtgttgctgatttgtccatataagtctcagcctacatcacctgtacaatgtggtgagggcaaaggagacgaaggtgcacaatgctttctgagcacctcatgttcttcgccactaaggccaacagcaaagctttaattctccagacaatatcaggcttcatcacatggccagacctccctatctttgtaacacaagcaggtatacctgtgacccatgacattcagcaaaattaatggctttctctttttcagctatagggaacagggaacattatgaccacacagggaggaaagcatacctttggaatatggttatctgaaccatccaattggagtggcagcagaataagaacacctgaaacacacagttaagttcagccagtgcttaacataaattgatgcacgggcagaaataagaggagagtcctctcttgcacacatagttgcatatttagtaccccaagggaatgctaataaacatcatattacagaggccagaagaggatcctttgggctctgtttgtgtattatcagaacatagcagtgaatagaatgagctacatgcagttttctattctatttacagccaaaaccgaatatttagaaaccaggggtgacctggtgactgcaatttgcaatgcctgaagggatgcataaatatagatatatgattcaaatcctgcaaagtccatcacaacactatgcaaaaatcacaggcttttagagctaataccatccagcttaaatggagaccctgcctccacataaatcaaagcacatggaagatcctttttcacactttatcttctcagcatctttgggagctaggaagaggaaaacattataaaatttagagagatgaaaaaggatatgaatacacgatataaaaatctcctaagaagaaagaatccaggcagttgaaatgttaattgtctgcctttttataacagagaaaacctgcttttaagatgcatactattgtacttcagaacaatgcaccagtggatctttgcaagctctataaattccaagaattactagggcaagtagaaatgtaaatttatctagctatttcactggtagaatataacaggagcaccaagctgggaatcagccaatctgcattaggacctgtctctgaaactcctaatggaagcaccttgtgctgggcacccgtgggacccaattcctgtatgagagtaacactctgtacttcatcactggtctaagcatcagatgaaattgtatatagaagatttggccattcatggagtattgcacaaatctaaaatactcagcactctttccttttcacttttctttcctatttttaatcctgggactggagggcactgaacaaatgaactgaggaacacagtcctgccttctaaaatttgttctggccattacctctcagcacaccataatctatcaggctgacatgctgcatgacaacctgctaatgtgtagttatatcctgtgcattccactaattgtgcagacattaaatactagatctaattccaaataattgatttctttgctgtatttgagaatattctatgctggaaggcatagagctatctttaaaaagcagaaagtgtgggtggataagaaaattgtattcagtcaaggggacagaagaattctactgcaaataatttctggccactagtaagtttaaaatacaaaatatttaagaagacaagcttaaaatgatgaatataaatcaaatccacctaatataaatttctaaaataaacaataaacagtaaggaaactgatataggtggagttgtctgaaagcacagcttgaaacacaaatttgcgtatatttgatttcttagtggagtgtgcgtcaggaaagatctacaagggagccggagaaaaagacagaaaaaggaaaggggccaagaagggcatgacctgattcagaaaggtctggagcataaagtgtatgcagaggtgggatttctccacgagaaaagcggggtgggcttttccatccccacatccgtctggttcccaagtctgggctcctaaccactactctacattcaatccttaacactcactgtcaacataatgtgaacttatttccaatgtcatctaaggtagaattacttgtgagaaaagactatagtatatttccatttagatgccagcctacatcctttcaccatcttctggtaccctcaccctgatttctctctgggaacaattccctcctccacctcattctctctagttcccatgaagtggactctaccctctgctctagaaatggagcaatcaacccatgcataaactaatcaatacattcacatgtgttagtcaccccttcttaggctctggaaagactcatccaaagagacaaagacaagacatagcccactcatgacacagagtggattgttcttaacttctttcgtttcctaattcccttcttcttttccctcagtccacacaccctggtatttgctctgaaatacatgggtccaggtgacctttactgtcatcatcatcatcatcatcatcatcatcatcatcatcatcaggtgtttataaaaagatagaaattccagtgtacccctaactattttccctgggaaccacaagaacatttaaggatcataaagagcctaggagtcaaaaacagcctactatttgaacaaatttatgtttaaatttttttaattttttatttgcttgtaaagatgggtctcagtatgttgcccagacagattttgaaagcctggccttgagtaatgctcctccctcagtctcccaaaccactagtattgcaggcttaaaccaccacgtccagcctgagcaaatttctatattgtccttttactgctgtaattgtacatatttttgttaccggtgagtttaaaattgtcaagtatttttttattatgtcagggcaaagaatccgtttcttctgtattttacaacacaagactatttcaggtaatagcctttcgctttggcccagggcctgtgtgcatttctctctttggtctcttttatgaggaatagttttataggtttgacatgaaatgaaaatttgctcctcaaaactttaaggtgcaacacaacaggttacagggcagtgtgagctacagagcaaagcagatcctgctctgatttggagatagttgaacagttcagaccggcctaggacagagacacctggtttactgatgacaaatctttaatgacactacaagtacatgataaattcatttcaggattattagagaaatgtgaccaggattaaaataagaaagtacttactcagaaagtgtcatggagtaaattccatgtaaacttgtatggtattctctggacccactgaaaaataagttggaaagagacaaggacaattgagggtacagtttcatactgacattaaatgtggatattcttacaaatgattttcaaacatgttttgttcagacccagagtgtttcacctgctggctcacagagttgggaggctacaactacaaatgccagaaaaaaatttttttaagtaagggggtagcaggggaaggctttgcctctctctcttcacagagtttctgctccataccctaattacttctggtcccaagccatgccaagggccaggccttctaaaacaactccttctgactcccagcttttgtcccttcctctggagataataaagatgaaaataaagcttttattttatttccttcaggttcttgaacattcaaactggcctccccacaagttgaacatgttcttatctggtttcagaaactccactgtgagtgatgaatgtgccccaacagaaacagggttacgtgccctcctgtgtctcagtcttcccaagcaggaaatggacccaggaaataggctcttcagatatggctatactgatctacttttccttcattctttttcctcactaataaaatagtgaggaaaatgtcatagacttatgcatgcatgttccaggcttcacattcacactttttagcccaacagagggagcagtaggatctatagtctctgactctggggggggtgtgtgtgtgtgagagtgtgtgtgtgtgtgtgtgtgtgtgtgtgtgtgttatattgtatatataaaagttgagaaataacactcaaaattgtccttcaaggcaaatggtacaattctttctcaatgatcagtttggagatactggtaaagtttagcatagttttttgtttgtttgtttgtttgtttgttttttggggtttttttggtgatggagtttcgctctttcacccaggttggagtgtgatggcgcgatcttggctcaccacaaactcctcctcccgggttcaagtgattctcccacctcagcctcccgattagctccgattagctgggattacaggcatgcgccaccatgcccggctaatattgtatttttagtagagacggggtttcaccatgttggtcaggctggtctcaaactcctgacctcaggtgattcaccctcctcggcctctcaaagtgctgggattacaggcgtgagccactgtgcccagcaagtttagtatattctaaacaaaaagatacagagatatttggggattcatttctgctataacaacactgatttttgtccacagtggtcataagaagtagagttttgattacatgtatcctccatgctaatttgcagaacagaaataggaagcaattatgtgatcgtcagggcgggggagaaactaatttttttcctcagattatttttaggataaaaatgtgaatgaaaacagcatcctatacttctgattttgatgaattttgactgcccttcccctcaattaggacaaattagtagaagtttattctaattaccttctgttcatctcaattattttaagcatttctattttattgtgatttctaaatcagcatgcttgagttttaatgtaaataccttctcctaaaaatgcaaaatgcattacaatgtagtgagactttaaataaagaaaaatgcagaaatatccatccaaataagttatccttcaaaaaagaatagcacattgtttagcctcaggagactgttccaaagagtaactacaagaaacacttttggaactcattttcccagattacttttggagtctgcttaagagtcaaaccagaaaagaaatctcactctttgtaggcagatcttactttctgacccaaaactgtaatgttagcttgatcttttctgcttttgttacacctgcatttcctcttttcttgactagttacaggcctatcccaccccacctctcccgtcaatcactacctcctgccaattttatctcttaaatattcatcctatttatctttgtttccatggcactagcaaaagtgcctcatctgtcctggactgccattacctcctaacggggctctgtgctctggtgttgtcaccctcaaactcaccctctctatgccatccgagtactccatcgaaaacagaaatctgcatgtattattctcctgattaaaattcttcagtggtacctagtcacatactggctaaaattattaacccaagattcataaactttcttggattggccttccaggagcatctataattcccttgaatctttatacaaaattttgtgtttgcatttatgcaaggaaagactcttccaccagtgtccctgagggaggaaagaataacaaccgaaagttcccaatcaaagccatgctacttaatgtgttacaaagactctcaacattcagtgcttcctcctagcctggtggcttccatgtaggctgaattctctcacgataactcagagctaaaagatcaaatgttccaacaaacaagacaggagctacatggtctttcataaagcacctcagaagtcacagggggtgaagtctgtcatcctctatgggtcagagcacccacaatcccacctagattcaaaaggagggacacagaccccacttctcaatgggaaacagtttaagatcttgtgaacatgtctcaaagctgccatagatcgtgagggagacaggtagaagtagaacacaacaagggtgctgtttttccctcctgtcagagttagatgaaacttctttgtggataggcttgacctagaggggcaaataaggtgatgcttttttccagacttttgataagttatacctgtagactttttgcttaagaactcttttcctcaggtcctgtttttttgttgttgttttgtttttaagaaattaaggtcattaagcagggtgtaaacgtacagtataaatttattaaaaggtaaagggctgatcagaggtattaaaaaatccatgccacatgcagtaaatttttgcttgatataaagtgtcaggaaatgagaccaaaattgcctttgagttgcaatcagtgctgtagagaaaaagcacattttgccttccttactaagatgaaggagtaatgttttcataagaagaaactgtcaaatgtgtattaaataaatgaagcataaaacaagctttcctgcagtttcaagcatgcttggattttaataacaagcatttatttatcccatgaatgaaaagttatatttgtgtccaagaagaaaggctctccactctccgctgggtattttcagcttttaacagtctccattacggatgaagtcactgatttgctctgccatttcacatcacattttgatgttggtgtttatgggagagataagagcctggactaaagaggggagagcaatgggaaaggatccttccagggttggatggagagtgtaagggaatgtggaaacagatagactagaattaagatgggatgcagaagctaaagcccagtagtgtgcactcatcaacattgtgtcagggtctcagggacccctccttgccaaattgtggatttagaaaaggggcaaaggtcatgttggaggacaaatgaggtgggaaacaggagggtttcagagtccccatcctgatagtgttataagatctaatctatgttttatgtaagagaagttgggtacctttgctaagcccaaactgggattcagagactgacagagctggtgacaccctggggcatccatttacatgtatcgttaggtgtgtggttggcaatttttttaagctaaagaattagagaagcatttgggaaactgggagaggagcaaaagtcaataaggagaacctcaaggtgacacgatggcgtctgctcccgtctggcctgagagactgcatggtggcccctgtggagagcaaggtgaatttcaaaagagaaagagttgttttgacaaaagactttgtgaagctcgggacattcgcagtgtggctttagcactcaagcctaggacaggacacacggctctaggcctaggtcccagggcaaccttccccagaaaggccactccaggggactagcagcagggtctgaccatggctggcagagcagctgccagctggagggggctggcaacaggcaccatagcaaggtgacttaatgggtcagaggagaaaagcacgagcagacttgtttctgaggatatggtcacatccctggggactctcagaaaaccaggaaaatccaatgggcaaaacactgaagcgctgctatcacacagatggacccaaagacccttgtcatctggctattaatgttaatgtgacctcacttctcctctcaggcagggtgagtttgcattgagattgcattagaaaatgattaataattgaaacattaccaaggtcattatcctattaagtaatgtgaatctaaggccgcttagaaattagaaatgaatgaatccaataagaattgctgaataattagactaggggcataattttggaatataaaaaggaacccaaatctatactttagccaaggttccaatccttctcattcctcagagagaaatggacaggaaatgacttaagaaaataagccatcatatttacattttgtatgtccccagacatctttgaggagatttcttcaaaggagacaagatgtgttctgccatttttaggagtggagtgtgggtgaccccagcagattgtttaccatccacctactgaacagcaggaaagatcagctctattcaccaggcgaagctatctatcacttattgtaggaatgacgaagggaattttggaaccctccattgttgttagatcctccctttgctcatacataaacacacacacacacacacacacacacacacacacacaaataagaacaaaacatttttgaccacagaaaagtaacagagggacaaagcatcttggtcacataacagaagactaagactgaaaaaagctttacagcatcttatccatttacctcctgtacccactaagatattgttgatgtaggcctttggcatccacagttttcaatttcatctcatgtaaagatcagtgccaaccactgaagatatggaggcagcaatattctgagctacttcagaaccaacaacttaattgaaacatcaaaccaaggccctcacacaatatttatggctatagtttggtttaatgccttatataattggtactgacatacacaagatttccatcaagtctttatatcctttcacagaggagtctactattctacatatgaagtaagcagcaaaaagcatattcaatcttataaaaccttttaaaccataacagtattatatgtcattatgtgtgtgataaaaacagaattataaatcatggtacaaaatagcacaaaatttgtaccatgatttataattttgttttcttcctcatcttatccaaaaagctgagaagtcataattctgccacctgcttttggataactagttggccttattccttttctactaactcttttctaaacatttgcatttgcatttgtaaatctaggaaaacagagagctttttttatttttaaggagcagcttccactttcattttgagaagctctgaaatccagtaaatccagttacgcattgcaatataccctggggtatgagtgcagataacttttcaaaatgacccccagcccaggaacagcttctatctttgcccctagagtgatcatctccttgcataccaggagaatagtcctctcttatccccatagaacctcgtgacaccataaaaagtaaacaaattataaaaaatggtaatttctagacatgaattatacaaatgaatgtatctgtagttatttagccactcttttcaaaattctaatgtaagcaatgctttcatacttcaaagtgtttaaaaagagtgttttaacctgaaatatcattttactccacaattgaattctagttgaaaataattatatttttagctgcaagtgttttgagtcatgggccaactaaagatttctggttatataattgaaaattatgtggttcatctatatgtttattgacttggattgactgagtcctgggggaaactgtgccgtttcattgctgatcaaattcacattgcaagccacatgtccagaatgctcactgtggccattgaaatgaatggaaattgtgagccagtttattttctaagaggccaaattggtagtctcctttagtttactgaacctaagttttaatagtaagtaaattttttaataaaattctttatgtatgtttatctttaaatatgatgtcttttttattattctgacccccaaagattatacaagatgcattaaaacttgaaataatgtctgaaaatgtgagaaagtaggcaagaataagccagagaaatttttaattaaactccaccttttttttcatttatggcataaagagtcaatatgtgaaatagagaatattaggaagatcagcaactccttagaatactgtaagagtcaccaaggctacaagcattaagtactgtatcttggtttagagaagatgatcaactacacattttgaaaaatgcattcacaaatgaaaacataaagaatgttttcctgataccaaataaagaatggttttagtacactttaccttatagcctcattaatttaaaatttagctaagtttagaatataaaaattgctatagaaaagtaaactagtctaccatatgagtaaaaaggaaagcatatttattaccttatttaacagatttaacataaaatagaaaattgatttccattaaatattcagaaaagtcatgtatttctatggcctgtagaaaaaaaaatcttcagtaagaacctgttgcttcatgatcatattaattttaaaaggcatctcatggataacaggtttgtattagtagcaaaattcaaagcctgatttgtgatattgtgagcaatattcataaagtacattaatatgttaaaagttacatggacacagagccacattaaaacacacctgcaatgtgttaacattttcagggaaacaaaaatagcaagaatattttgcaagaaaacaaacaatgtgaagataaacaagtgggagattgtaggcaatagaacctatggctaaagtttcaagtaattaatattatattttaagcgaaagactggtagaacatgctcaaaataataaactactctttttcatttcctctaatgaaaaaacaatgtgacacattaaaatcttttatctgtaatgaatgagggaaactgtcatccttgttaacttcagtacaacactgcacaatagttaactcctgttttggtggtggagtatgaatttcaatccacaaactcagttgtgcataatacatcacaatttaaattttccttagggccacttatttccaacagaatagagaaatggtgttcataatataatttcatctatataaaacggtgttcaaaataaaatattatttaaatctttttaaaagttaattggccaattaaacaaaaataataataatacaatgtgggatttaaaacgtgtaaaagtaaaatgtatgataacaaagacataggctgggggaagagaaatagagccatactctcaaaagttttttatagtatatgtgaagtgacataatatcgcaacataaattgcaataaaagaaaggtatatgccataaaccattatgataacaaagaaaccacttaaaatgaagaaacaaggagtttttttatgtcaaaaaggacaataaatgaaattatgaaaaatattcggttaatcaaaaagaagacaaaaaatggggaaaggaaacaacaggtgagacaaatagaagagaaagaggaagatgatagatttcaacctaaacacatgaataatcatattgaaagtaagtgatctaaataatccagttgacatgcaagatgcaagtatatgttacctataagaaaactattttaagcataaagacacaaatagtttaaaagtaaaaagatagaaaaagttataaatactagtatttagataatacaaatccaaataaagctggagtgactatagtaatatcaagacaaaatagatgacagagtgaagaacattattagggataataaaagtcatttcatagcaataataaagttaattcatcaagaacaacaacaacaacaaaaaagcctgaacatttatgcacctattaagagagctacggaaacatgttgcaaaaaactgacagaatagcaggaagaaataaacaaatccagaattatagtcatagatttcaatacccctctttcagtaattgatacatcaaggagacataaaatcaataagcatataggagatttgaataacactatcaaccaacttgacctaataaatatttatagaacactgtacccaacaggaatggaatacacatccttttcaaatacacatggaacatttaccaagatagaccatattctaagccattaaaatgtcacaataaatttaaaagaattcaagtcatacaaagtgtattctctgaccacaatggaattaaattggaaattaataaccgaaggatctccaaaaaattccccaaatatttggaaactaagttatatacttctatataacatataggtcaaaaaataaaagagaaattaaaaaatattttgaactgaatgaaaataagaacatgatgtattcttatatttgtagtagtctgctaaagcaataggtaggaatagatttatagtactaaacacctatattagaaaaaagtcacaaatcagttatctcagtttccaccttaaataaccaggaaagaagagcaaattaaatccaaagtaagcagaagaattaaaataataaagactaaagagaaatcaatgaaatataaaacagtaaaacaataaagaaaatcaatgaaaccaaaagttagttctttcaacagattaataaaattgataagcctctagccagacttactaggaaaaaagagaaatgatacaaacactttaacattattaataattatggaaatgcaaaataaaaccaaaggaagataccactacacacctattatcatgactaaacttcaaaagactgaccataacaagtgttggtgaggacatgaagtaaatggaactcaacactgcttccaggaatagaaaatggtacagccactttggaaaacagtttggcagtttattgaaagattagacatacctactatatgatctagttattccacttctaggaatattcccaggagaaataaaagcacacatccacacaaagattagtacacaaagtttatggcagtttcatttgtaatagccccaaactgcgaacaacccaaacgtccatcaacaggtgaatggataatcaattgcagtaaattcatgcaaatagaatactactctgcaatttaaaaataatgaaccattgatacacgctatagcatggatgaatctcaaaatagttatattgaatggaagaagacagaccccccaaaaaatgtatactgtataattctatgtatatatagttgtagaaaatgccaactaatctacagtgacagaaagcagatcagtcattgcctgttggaaggaaatgagaagagattacaaagagacatgaggaaactttgacaaataatggataggtccattttcagtgatggctgcacggagataaacacaagtcaaaacctatcaaactgtacacttaaaatatgtgcaatcaattatatgtcaattacacaacaattaagctgttttaaaactcacgggcaaatatgagtaaatacataaacacagtaaataaaaagtttatttcttaacggtcattcacaccaatcaagacaggagatactaatttatttaggtctttgtaggaacatcagtaaaggtacagaagatccatttgaatttatgttattatatgtctaaaataacctaagatacactgcatgggttttgtataaactcgttaagaaaacaagattattgtgtttctgacaatttgtaataaaaactcaatttagaatttttcttgcccaatatctctaacactgtatctatggtggttctagttttgagattcattgtgcacagtgtaagttttggtgccctttgtctcatgttttacacaatcaaatgagaatatgtttgtatgacttgggacctttctatttgcagttcagattaaataagactgagaatttctgactacttataaccaacacttgcagaagtaatgcttacaattggtaaagtgttctttggggaactgcactcgataaatgttacaatcctagtttgttgcagcttcagttgtaattccactctgaaattcagtgggtgaaaaatgggaaaagatcaggctgctagagagagggataaagtaaggcacatatgattctaggatttttattacaaaacaaaaaattacatgagagagtgtctttatattattttctgaattctgcccactttcctggagaaaaacctaaattcctctcccagtcttgtaatctcttcatctgcataaagcctacaccttcaaaacaattcctagactgaagtaattaaatcaagtaccatcttagcatgcaaactctttgaaatatataatacacttagacagattcaggtttatgttccccaagtgcttcataaagcattaccaagactaagttctcagttgttcaataaattggattggtgtctactatggttatgcatatctttttgtgtatatcaacatttgaaatgttgtactgttatttataaatatcctttgtttcaaaaaagttttcaaaactgtcacttcagttatgtgtttttatcgatttgcttgatctgcataagggtgttctctgtttcatatccatttgtatatagttatctcttttgcctctgaacattgaaacagaaacagtgttgtggtgaagagccctagcgcagcctcaccacgctagcctcagccttgggcaacattccacctcttctgcgtgattcctcaaaccgtgtgcatagggaggttgttcacagggttgttgtgaggatcgatcaaggtaattaggtatagatttttatcctttagaccagcacatagtgagcagtccaaaaaaaaaaaaataaacaagagcacctttgaactgcaaaaatatttagggcagggcctaccaagtggttataattatcttattacatgactgaaatgcatcctagcaggagtggaatacttgaaaattattatttaatcaaaattaatatttcttaggcagagaaggcctaaaaagaatagtataaaatgaaaagacttagtttaaatttcaactttggcacattaaacaactaattctggtttcttattttattctaacctgccgatctgtagtttgtaaattggacatgacctgttcatagtagatgcttagtgaatgcgtactgagagattactcaaagatattgtctacaaaagcattttcaatacttttatatgtctgatagtataagatccctttagtttcaggaaaaaccataaaattgagtgatatttctcactttatgggtcattattactcatgtagtaatatttctcactagtgataaacaagtggagcaaatgtgactctgcagggcaattgttgcattaaaacctgaactgcaaatatttaatgctcacaagaatttttctccctccccatccatgtccacttcagtgagagacccaatgagaaccctatatccacttacagaaaaccagtgctgaaaagttccacacagctgaccactaaaacatatcttgaattttacttttttcccaaggaaaatgccattgtctgtaacgttcatagtcctttaaagattattttgttcatttcacaggtctcctgttatggctggaggtctctttgctgtggatcggaaatggttttgggaattgggtggctatgatccaggtttagaaatctggggaggagaacagtatgaaatctcttttaaggtaagccccaagaccctcttcacactatatctgtataattttgacaattctgatagaatatcagcatgttgctctgtgacctgtgttctgggatgacttaatggtaatagatgtatcaccttcccaagtgagctcttgtagtttctttcttttttggtttttgtttttattttttcttgatatacaatcattatacatatttgtggggtacatgtgaaattttgaaacatgtatacaatgcataatgatcaaatcagggtaactgggatatccatcacctcaaacattcatctcttctttgtgttggaaacattgcaattcttctcctctagctatcttgaaatatacaataaattattgtgaactataatctccctacttgtataaggccatttttgcattgctataaagaaatatctgagactgggtaatttacaaagaaaagaagtttaattggctcacagttctgcaggctgcacaagaagtgtggtgctggcatctgcttctggtaagggcttcaggaagcttttaatcattgtggaaggcaacagggagccagcatgtcacatggtgaaagcaaaagcaagagacgcaggggtgagctgccacacacttttaaacaaccagatctcacgagaactcactcaccagcaaggggatggcgctaagcctaattcttgaggaatccattccccatgatccaaacacctcccaccaggcctcacctccaacactgggggccacattttgacataagatttggaggtgacaaacaaccaaattatatcactacagtactatcaaatactagaacttatctcttccatttaactgtatttttgtactcattaaccaacttctttttttgccgcctccccacccccactcccttctattcccagcctctggtaaccaccaatctaccttctacctccattagaccaacttgtttagctccccatatgagctaggacatgggatgtttttctatgcctgatttatttcacttaaaataatgaccttcagttccatctatgttcctgcaaatgatagtatttcattcctttttatgactgcataatattccattgtgtatatatactacattttctttatccattcatccagtgatggacacttaggtaactattgagaccattgtcacaaaaaaatgggaatgcagatatcacttctacatactgagtccctttcttttgaaaatatacccaacattaggattactagattatatggtagttctattttagtattttgaggacgctccatactctttcccctaattgctacattattttgcatttccaccaacagtgtaggagcattcccctttctctgcatccttgccaggatttttaaattttttgtctttgagataatagccagtttaacttgggtaagatataacctcaatgtggttttgatttgcatttctctgataactaaagatgttcaacatttttcatatacctgttggccatttgtatgtcttcttttgagaaatgtctattcatgtattatgctcatttttaaattgaattatttgaaggattttactgttgagttgtttgagttcattatatattctggttattatttctttgtcagatagatagtttgcaaacattttctcccatcctacaggttgtctcttcactttgttgattgtttccttgctctacagaaactttctagcttgatgtaaatttgtctatttttgcttttgttccatgtgcttttgagatcttagccaaaaaatacctgtgcccagaccaatgtcctgtagtgtttccccagcattttcttctagtagtttcatagttttgggtcacatagctaagtctttaatctattttcagttgatttttgtacatgatgaaagacaaagatctaatttcatttttcttcacatggatatctcattttcccagcatcatttattgaagaaactgtccttttccccactgtatgttcttgatgcctttttgtcaagaatgagttggctgtaagtgcaaggatttacttctgggttctctattttgttccattggtgtatgcatctgtttttatgccagtaccatgctattttgattacaatagctttgtggtataatttgaaatcaagtaatgggatgactccagctttgttctttttgttcaggactgctttagctatttagggccttttcttgttccctacaaatttttggatattttttccgtttctgtgaagaatgtcattggtaatttgacatggattacattaattatttagatcatttctggtagtgtagatattttaacagtattagttcttccaatcaaagaccatggtatatctttccatcttttgtgtgtcttcagtttctttcatcattgatttgtacaggttatttcacttctttagttaaatttattcttaggtatttttaagctattataaatgggattgttttcttgattgcttttcagattgatttctgttagtgtatagcaactttatagaattaatttatcagttccaggaacttttggtggagtctttaggtttttctaaaagtaagatcatgtcatctgcaaagataatttgacttcttccattacaattttgatgccctttgtttctttatcttccctaagcactcaggctaggacttccagaactaggttgaataaaagtgatgaaagtgagcatccttgtcttcttctaaatcttagtggaaaggctttcaattttccccctttcagtgtgatcttacatgtgggtttgtaatatatggctgttatcatattgagatattttctttctatatccaatttgttaagagtttttatcatgaaggaatgttaaattttaccaatactttttcagcatgtatcaaaatgatcctatgctttttgtccttgattctcttgttgtgatatatcacacttattgatttgtatacgttgaaccatctttgcatctttgggatgaagcccacttgattatggtgaatgttctttttaatgtcttattgaattatgttttgtcgagggtttttacatctatgtttatgaggaatgttggcctatagatttttttgtgtgtgtacctgtctagtttagctatcaggataatactggcattatagaatgagtttggaagaattccctcctcttcaattttttgaaatagtttcagtagaattggtattagttcttccttaaaagtttggtagaaatcagtaattaatccatcaagtgttgggcttttctttgatgggagactattactgctttgatttcattattccttattgatctcttcaggttttctttttcttcatggttcaatcttcataggttgtgtatttacaagaatttatctacttcttctaggtttccaatattttggtgtacagttgttcaaaatggtctctaacaatcctttgtatttctgaggtctcagttgttgtgtctcctttttcatttctgattttatttatttgagtcttctctcttccattcttagtctggctaaagagttgttacatttgtttatctgtttaaaaaattggctggacgcggtggctcacgactataatcccagcactttgggaggccaaggctggcggatcacaaggtcaggagttcgagaccagcctcatgaacatggtgaaaccctgtctctactaaacatacaaaattagttgggcgtggtggcgcatgcctgtaatcccagctactggggaggctgagacaggagaattgcttgaacccgggaggcagaagttgtagtgagccgagattgcaccattgcactccagcctgggcaacaagagcaaaaaactccatctcaaaaaaaaaaaatcaattttacagttcattgatcttttgtattattttattagtctctatttttaagttcaacttttattttagattcagggggtacacgtgcaggattgttacaagcaaatattgtgtgctgctgcagtttgggttataattgaatgcatcacccacatagtgagcatggtacacaacaggtagttctttagccattgaccccctactccctaccccctcttgtagtgatcagtgacttttgttgtcatatttatgtccatgtgtactcaatgcttatcctcctcttataagtgaaaacatgtggtatttgattttctgttactgcattaacatgcttaggataatggcctctagctgcatccatgttgctgcaaaggaaatgattttgttcactttttatggcagtgaagtattccatggtgtatatgtaccacattatcataattcagtccaccattgatgggcacataggttgattccatgtatttgttatcatgaatagtgctgcaatgaacatatgagtgcatatgtctttttggtaaaatggtttattttcctttggacatgtacctagtaatgagattgctaggttctatttttagaaccagcaaccaaccccagcatggtagttctatttttatttctttgaggagtctccaaactgttttccccagtggctgaactaatttacattcccaccaacagtgtataagtgttcttttttctctgcagccctgccaacatattatattttaaccttttatttatttatttatttatttatttatttatttatttatttttgagatcgagtctcactctgttgcccaggctggagtgctgtggtgcaatctcagctcactgcaatctccgcctcctaggttcaagtaattatcctgcctcagcctcccatgtagctgggactacaggcacctgccaccatgcctggctaatttttgtattttttgtagagacggggtttccccatgttggccaggctagttttgaactcctgaccacaggtgatctgcctgcctcggcctcccaaagtgctaggattgtaggcatgagccactgcacccggcctctatttttactttttaataatagcaattctgaccggtgtgagatggtatctcattgtagttttgatttgcatttatcttacaattggtgatgttgagcatgtatcaatatgtttcttggccacttgtatgtcttcttttgagatgagtcctttgcccacattttagcagggttgtttttcacttgttgattcatttaggttccttatggattcgagatattagacctttgtcacatacatagtttgcaaatattttctcccattctgtgggttgtttgtgtactctgttgatagtttcttttgctgtgaagaagctcttaagtttaataggccccacttgtcaatgtttggttttgttgcaattgcttttgagatcttagtcataaattctttgccaaggccaatgtccagaaaagcatttcctagattttcttccataatttttatagcttaaggtcttacatttaagtctttaatctatctcgagttaacttttgtatatggtgagaagtaggagtccagtttcattcttctgcatatagatatccagttatcccagcactatttattgaataggaagtccttttcctattgcttatttttgtcaagtggatatccagttatcccagtgctatttattgaatatggagttctcttctcattgcttatttttgtcaactttgtagaagatcagttcattgtaggcgtgctaccttatttctgggttctccagtctgttcccacgctctatgtgtctgttttcgtaccagtaccctcctgttttgattactgtagtcttgtagtacagtttgaatttaggtaatgtggtacctccggctctgttctttttgcttaggattgccttggctatctgggctcttttgttgcttccatatgaatttgagaatagtttttttctaattctgtgaaaaacgacattggtaatttgacagaaatagcgttgaatctatagatagttttggatagtatgactattataacaatatctgttcttccaatccatgagcatggaaattttttttttcatttttatgtcatctatgatttctttcatcagtgttttgtagttcttcttgtagagattttttacatccttggttagtgtggtcctacatttgcttttgtgtgtgtggctatcgtaagtgagattgcattattgattcaactctcagcttgaatgttatcggtgtataaaaatactactaaattttgtacattgattttgtatactgaaactttactgaagccatttatcaggtctgtaagccatttggcagagtctgcggggttttctaagcatagaatcatatcattagtgaagagcgataatttaacttcttttcctatttggatgatttatatttctttcttttgcccaaatgctctaagtaggactaccagtactatgtcaaataggagtggtgaggatgggcatccttgttttgttccagttcttaatgaaaatgcttccagcttttgcccattcagtatgatgttggctatgggtttatcacagatgtcttttattattttgatatatatttttaatgcctagtttgttgagggtttttatcatgaaaggataatgggatttatcaaaagcattttctacatctattaagatgattatatgggctttgtttttaattctgtttatgtggtgaatcatgtttattgatttgcatatgttgaaccagccttacatccgaggaatgaagacttcttgatcatggtgaattagcgttttgatgtgctgctgaatttggtttgcttttattttattgagggtttttgtgtctatgttcatcagagtgactagcctgtagttttcttttttcattgtgtctttgtcagattttgacatcagggtgatactagtttcatggaatgagttagagaggagtccttccttgttgattttttggaataattttagtagaattggtagcagctcttcgttgtatggttggtaaaatttggctgtgaatccatctggtccggcctttttttgtttgctggtttttcattactgattaaatatcagaactcgatattcgtctattcagtatctcaatttcttcctgactcaatcttgggagtctgtgtacttccaggaatttatccatgtcctctagattttctagcttgtatgcacagaggtgttcataacagtctctaaggtcttttttatgtctgtggaatccattgtaatgccttctttgtcatttctgattatgcttacttggatcttctctctttttttctttattaatcttgctagcggtctattgatcttgtttatcctttcaaagaaacaactttttattttgttgatcctttgtattgatttttgagtctcaatttcatttaattctgctctgatttcattatttatttttttctgctaattttggggttggagtgtttttgtttttctagttcctctaagtgtaatgttagattgttaatttaatgtaggtattcagagctataagctttctttttaatactgcttgtgctgcgtcccagagattttgatatgttctgtttctgtttccatttactccaaagtcattcaggagcaagttgtttaggttccatgtaattgtgtggttttgagggatactcttagtgttgatttttatttttattccactgtagtctaagaatatgctttgcatgaatttgatttttttgaatttattgagacttgctttatggctaggcatgtggttgaggttagtgtatgttccgtgtgccaaggagagggatgtatattctgtggctgttaagtggggtattctgtagatgtctactttgtccagttggtcaagtgttggatttaagtccagaatttctttgttagttttctgcctcaatgacctgtctaacactgcccatggggttttgaatagtccctattattgtgtggctgtctgagtcttttcataaatctagaagtacctgttttatgatctgggtgcttcaatgtttggtgcatatagatttataataattgtcttgttgttgaattcaaccatttgtcattatgtaatgaccttctttgcctgtttttactgtttttggtttaaaatctgttttatctgaagaatagtgacctctgctcttttttgtttaccatttgcataatagatctttctccattcctttcctttgagcctatgggtgtcattacatgggagattggtctcttgaagacagcagaaggttgggccttttttttttttaatccaacttgccactctgtgctttttaagtgaggcatttagaccaatatgcgaggttttgattctgtcatggtgtcaatggctggttgtttcatggtctcaattgtgtagttgttttatagggtctatagactacatacttgcatatgtttttgtggtatctggtatcgatttttcatttccttgtttagagctccctttaacatcttttgtaaggcaggtctagtagtagcaaattacctctctggaaaagattttatttctccttcacttttgaagcttagcttgaggggatataaaattcttggttggaatttttttatttaagaatgctaaaaatatgcctccaatctctgacttataatgtttctgctgttagcctgatggggttcccctcataagtgacataaccctttactctagctgcctttaagatttatttatttgcattgaccttgtaaagtctgatgactatatgtcctggggatggtcatcttgtatagtatcttgcaggagttctctgagtttctcaaatttacatttcaacctctctagcaagactggaaattttttatagattatattctcaaatatgtcttccaaattgcctattctttcttcttctctctcgggaataccaaggagtcataggctttgtctctttatgtaatcccatatttattgctggttttgttcatatttttgattcttttttatttttgtctgactgggtctttgagcctttacattctttcctcagcttactctagtcttttgttaagacttccaacagtatttgaaattttcatagtgaatttttcaattccggaagttcagtttggttttcttaatatggccatgtcattgttcaagtcttaaattgtttttctggcttccgtgcattggctttcaattttctcttgaatttcattgagcttgcttgccatccaaattctggattttattgttgagcttccttgccatccagaccctgaattctatgtctgttatttcagacatttcaatgtggttaggatccattgctggggagctagtgcaatcctttggatgtaaagaaatgctctgactttttgaattgcctgagcccttctcatatgaggaggctggcaattctttttcctttttaaattgctctactatggatgaggccttttgtttttatatattccttttcccttgagggtttgactgtggtgtatgttgtgtatagttgattgtcttcatttctgagtgctttcaaagggccagggctctgtatgggctacttacttgtggatagtttcctgctttgggtttcacaggtgttgggtgttgaagaaattttttctttagtggtgtaattcaggatgcgaaccagtagacggcgcttaagagtaagggccagcagataggctcttagccaagctcctcttggagcttactgttgtcggctttgttcatatttttaattctttttttttttttttttaactgctgcatatgcccttacacctttttttgttgttgttactgactgctgcatatgccatatgcccttactcttaagtggtctggagatgggagatggggggcaagagatgactccctcaccaactccattcctaggtcttggtagagcccttttcaattattggtgttgcctccatgatttcttagtctcaagcgaaacgctggcaaactgctttccctcctccctcaggggcagcccaaggcaaggtttacatcaccaggaaatccacaattatttggggacctactggtcctctgagcttggcagagtcagaacaggttgtggtgtgtgtctgcaggtggtctggtgatgcagtgggtcaagggcagaggatgcccaggcaggacagtaataccatacatgtggcacccacggcctgctgttcttatcccagcagatggctgtggggccaagccagctcacacttacccaacccagtaagtctttctgcagcgtctgccccaggagtgggcctgaccagctaggcttgtcccaaaccttctgtgccaagattgctgggcagttccaggtgttccacgctgtagggatccctgaggaagaaggtgctactggctaataggccacacccttcccaaaacagtgttgttgagagaggggcacccagctcccacgccagcacacaaacctgtgtatcactcttctaagtgttctgagagtggcggggggggggtcttccccttctcaaactcaagccaaagatctcagctccaaacccctggacagtgtgctcgaatcctgggagttttgggaccacacctacagttttgtctgctgacccctcagggtccagtgctggctgtgcagaaggagccaaactactcccaggcaaccagcaaaacactcaggcaggacaatgaaagctgtgctgtaggtaccttcctgagggagtgaccaggcaggcagtcttgggaagatctggtggacaagggggcacaaagatcagatgcacccccgtcccacggaagaaatagccaagccctgctctctcccagcctggcagaaagcaggagctgttgtcactcagaacaagatggagagcctggggggaagggtacctatggtcacattttgttgcagctgcagtgtgcacggcaaaaccttctgggatccatgcaggtttgagctcttcctctgccttatctccaggcagttccctctgccaattcaaatgtctctgaaggtcataggatctcatgtatctaggatcccagatgtccacagtgggagtgtggagtcccggagctccttcactcgccccttccttaggacctagtcaggtttgggagctggtcctcagcattcaccaactccaggcaagcttcccagcttcttccctcttcaaatatggtgtatatgtcacctatcaactttcagtattttctttcagaagatctgttcaaagtgtgatggtttactcaatattttgtttcctctcagtgggagaggtgtctcagctatgtctaattaactatcttagttcagtcactgttttattgtctcagtttcatatatttatgttctgatctttattatttcttttattttgctaattttggggattggtttgttcttgcttttcttgaggtgtatcactaggttctttatttgaagtatttgaagtttgtctattttttatgtaggcatttattgctatataaacttccctcttagtactgcttttgctgtatcccatatattctggtgtgttgtgtttccaattttgtttcaagaaatacttcaatttccttcttaacttcttcattgacccattcgtcattcagggcatattgtttccatgtactggtacagtttacaaagttttgctttttattgattctggctttattctattttggtcagacatgatttcaacattttttaatttgttgagacttgttttgcggcctaacatatagtttattctggagaatattacatgtgctgatgaaaataatctgtattgcatattaattggatgaaatgttctgtaaatgtctgttaggtccatttgttctagtgtatagttcaattatgatgtctctttgataattttctgcctaaatgatctgcccattgctgacaatggggtgttgaagtattctactattattgtattgcattctatctgtccctttagatctgttaatacttgctttatatgtctgggtgttttggtattggtattgggtgcacatgtatttataattgttatatcctcttgctgaattgatctctttatcattatataatgatcttgttttttttacagtttttttttttttacttaaagtctcttttgtgtgacatcagtatagctactctagctctctttttatttctatttgcgtgagtggaataaatttttttcatcccatcaccttcagtatatgggtatctttatagataaagtgagtttcttataggcagcatatagttaggtcttgtttgtttaattcattcagtcactgtgtcttttaattggagaatttaataaatttacattcaatgctattatggataagtaagaatttactagtatcattttgttacttgttttctagttgctttgtagctcttcttttcccttcttccatttttcctgtctttgtggttaagtgatttgctctgatagtatttttcatttgttgctttttactttagtgtatatattatacacttttcatttttagtgtttttgttatatatatatatatatattttttttttgctttcagcactctgaatctatggttccactccctgcaggcctgtaaggtttctgctaagaagcctgctgtcaggcatattagaactcccttaaatgttatttgcttattttctctcattgctttcagaaattttctttgccttttacctttgtgagtttgattataatatgttttagggtattcttgtttgggttgaataaaattggagacttttcactttcttctgtgtgggtatttatatctttctcaaggtttggaaagctctttgttattagttctttaaacaaactttatgttcatttgtccatgtcagttccctctttaactccaataaactgaatatttgcccttttgatgttgtcccatagatcccataagctttcttcatttctttgtattctttttcttttttctcttctgtccgtatattttcaaatagtctatcttcaagctcactgattcttttgtttgatcagttctgctattgatgctttctcttgcatttttcatttcatgcattgtatttgtcagccccaggatttctctgtgatttttattattatttcaatctctccgttaaatttctctgataaatttttggattaactatctgtatttcctttaggttcgttgacttcctcaagacagctattttgaattctttgtctgagaggtcacacatctccctcattttagggttgacctctggtaccttactttgtttgtttggtcatgtcatatatcccttcatcttcttgatgcttgtggatatggaacaatgtctacacattgagggattaggtatttattttagtcttctttgcccagttttgtttgtgcctgttcattttccaagggcttttcagagattctaagcaaactgactattatgtttcctgagtccagctataatcactgcagccatttcagcagtaaataaccccctaagcccaggcattctacaagtctttaaaggactctcaggttgatgtggtttctcagtccagacagacctggggaatgcccaaagaagatacttgtgtggaaactccgtacagggctgtgtggaaactctggacaggggttcaagcctagaagactgtcccagtggcccagacaagcatgtctcccagcagatccctgcacaggcaggatggatcctcaattgcaacaaggagaacttggattgagactgggatccctcaggatctgctatgggcaggaaaattgagtcacattggctcaaactgtacatgtttcctagcaggtccctccacagataggatagttccctgactgtagcaggaggggtcaaagctgatactaggccctcttgcaatttggcatcagagactggaaaccccagtctcagctcagagggtgcaggtaacacagcaagttcctgcacagataggacagtttcctgattgccgcaggagagctgggagctgatactgggcctcctagagatctgctgtgggacagtggctagcatgcctgtcaaaatggctcagatgggcccacctctcccagcaggtccctgcacagatgagataattccccaactgcagcaagaggcactggagctgagaataggccttcttgggaatcttctgtgtgacagaggctagaaccatctccttggttcagaaaggcaaacatctcccagcaggtctcagcacatacaggatagttccccaactacagtgggaggggtgaaagctgagactgagccccctcggggagctgctatgggtagaggctggaaagcctggtctcattggctaagagggacgtgtgtctttcagcaaatctctgcacagacaggatagtcctctgattgcaacaggagggtttagagctgggagtaggccctctagagacctgctgtgggacagagactggagagtctattaggcaggctcagactctcaggctgcaagatatgggcaattcgccctctgggcccttgtgagagccactctgagctaggacctcagctgagagaggctggagcaacaccatggcaattttcggattcactgcctaaactgatgtcagtgggcagatgagcctttcacccaataagctaacgtgcgagggtccttccaaaccccttggcagatggttttttattataggctcaaagaaaaatggggctataaccaagttccttgggggacaggtctgtttccatgcttgaacttggaagcaagattgatgggacaaaacacgtacgttggtgttggtccacactatcaaaacaaacctcctaggtcttgagctccattgaggtttcacagactcctacctgaatgttgaggcttcttcagagagacttttgactgtggatgggtgcagaatatttgtttttgtagggggatgtgagcaggttgccttctattttgccattttggtgatgttgctcctcccaagtaagtttttgaatgagagaaactacttccttccaatctttcagtgagatgtagccatgccatatgcaaaaagaaataattcaagctttcatttgcagggaggaaacttggtattctaatagatctactgttccactaacaagtgcgttccttctaaagcacctaaaacatacagatagaagaattaagacaaattaattaaaatgaaagaaatcaagttattgcagctttttatgtttgtattttttctagaaagagtaggccagattttgatcttaagcaattatttcaaaattgcaataacagaagaggaaacttaaaaatacaaataacagtgtacagctcttcttcatatgtctcatatgaacaatttttttattatttttatctgaaattgcccagttctctacttactttgatcagtaaaagtatatactttattacacacacacacacacacacacacacacacacacgtataagataaaatatcaaatttcagagcttataaataaaaataattacgataacatatgaagatgctaaccaaaagaaaataaagagcaaaaggttatactccaaactatcaagatggtatttaaaaaaaaaaaaaagatctcataaaataaaacttttttctctttttccttcattacagtcattatttattagaaatgtaggtggattcttgcaacatttcccatacagaaatctcttaagtaaatcagctgtttctaattacttctattataaaatctaaccagttattgctgagggaaaaaaatgcattctgaatatagtacaagtcaaatgtaagaatacagctaacttttaaaatgtatgcataaaaagcaaatgataaaactgattttattaaactgtaacagctatattcaaataagggaggagaacatccctcatattatcttatgcccaatttctgcctcaaagaaaaagtaggtgttaaagaaaagacagaagtcaaatcagtagtcagacagcccggcgctgcattccaggcctggtagttaaacatcaacccctgacctaaccagttatgttatctatagattccagacattgtatggaaaagcactgtgaaaatccctgtcctgttctgttcccttcagattactggtgcatgcagcccccagtcacatagccactgcttgcccaattgatcatgaccctctcaggcagacccctctagagttgtaagcccttaaaagggacaggaatagctcattcagggagcttggtttttggagacgtgagtccaccagtgctcccagctgaataaagcctttccttccacaactcagtgtctgaggggttcttgtctgtggctcgtcctgctacacaacgtgttaagagaaatgttatgttgtcttcaaagtgtcataaaataagtgtcaccaaagagaaactcaggaagcataattgtaggcttcagaacatctagaaatttccctctcactatggtggcagtaatccctgaaataccatctattaaattagtgcttgttttccccatcactcaaacgtatctaacgtcaatctaaggcacttttaagacctttttgtagatgcatttttagaaatctttgaatttactaacgtcttttgggttcttctgttgttatatcaatagttgtacactttgttacagtgtgtgtggcaggaggtagtactgatagtactaataactatagaaatagcatctactacctttacttggtagtgttaccagaaaggggtcctgatccataccccaagagaaggttcttggatcttgctcaagaaagacttcaaggcaaacccgtagagtacagtgaaagcaagtttattaagaaagtaaaggaataaaagaatggctactccataggcagagcagccccaaggtctgctggttgcccatttgtatggttatttcttgattgtttgctaaacaaggggtagattattcgcgcctcccctttttagaccatatagggtaacttcctaccgttgccatggcatttgtaaactgtcatggcattggtgggagtgtagcgatgaggacacgcagaagtcatttttgttgccatcttggttttggtgggttttggccagcttccttacggcaacttgttttatcagcaaggtctttatgacctatatcttgtgcagacttcccatatcatcctgtgactaagaatgccttaacctcctaggaatgcagcccagtaggtctcagccttatttacccagcctctattcaagatggagttgttctggttaaaacgcatctgacagaagtacacaccagatgctgagctgagtgctttgtgtgcattatctagtttaaaatcataactttaaaaggtgggtattctcatttcattttatagatgaagaaactgagatataaaattttaaagattattgtttttgagttttaaaaatcaaataaattacccaacgtcacttagagattaaaatgttctgtctctgtttaattgtagagaatgcagaaacatgaaattttctgacatccaaattatatctaccaacaccattcttaagttcactgttaaccttttgatccctacctaatggtttctctcattaagagtagtctcttcactaaagtctattaatacagcaacaaattttctgctgatcctggaaaactaatattgattatcagatattgttcaaatattagctgggtgcaaagtttacaattgcaccttgaactggaagaacagaatattacatttcatccttaaagaaaaaaagaaaagcattaaagcattaaagaaaaaaaatggcattgctgtatttgcagtgtcactgaaattcaagggatattttttagttttcacagttcaagaggtttttttcttaaattttcttaattcatgaattctttaagcttaaagtattattcagaaaattcctattaagcaagagatacctggctttgaataataaactggttggtggataaagttgctattgaaaatctggagagtttgcaaaatatatattttgcattctaaatcacaaaggtgttttttaggcaaccgtaaacttgcatctctcacttctctgtcacttgtatctatcacatcttttctgagtgacctgagattttattgcctcatttcctatttttcagttatctgtcattctgaacgatataattggaatgcagccctatcgtttttgtctagaaaccatggcaacagtactggaagttcaggactaaattgccccaggttgtttggtgggaatgatagattctttggtgacagctctgtcttaatggggtcccatttcagacatagtccttcattcttctcactatcgtttgctgaccctgggggttcctgtccctccctgttagtatttgtgacatgaatgggacaaagttaaacaggctttggtagaatttgcagtgagacaagaagaattttctgtgtgtaaaaggaatcaaaagagttgtagacaaatatctctgttaaatggtaataaaaatagaagataaaaatcaaacatctgcattttggaacatttttcatcaattgtgattaatttttacagtggaaagcactgtaaaatataccctggtcagcatttaaggtctggaaaacacgtctggataactgagagtttactagccgattttaggccataatatagaaattaagtccagaacttaagtgttctaattcaaaagacttacaaatggtcattatcatgcatctttgtttcctgtttacccttgaaacaaagaatcatttcactaaagtgtatgacaaaacttcatggccgaacgaaaaaaattccagaaaattgctttatctgaaggactgagtttttgctcaaacagtatttgactaggagtgctcttcaaatctgtttctatgtaaatatatttcctttattttcctaaaatctgactagatgagtaaatttcatgccataacataaacgtctaccctgtagaattttcaggagtcagctgagaaaatgggctctctggagaaatgatctgtctgcactgtgtccagtcttcagtctcttttaatattaatctggactcctgaatggctcagaattatccaactgtctttcaaatgtttctagattagccagctgcaggggttgggggacagagacagtattaagtcaatccttcaaccagcttttattgagcatctaatgtatgccaggcattgttccaaatccaggtacttaatttggagttgcccctggaaacacagaggagcctgagacagacctaacgatgtgcataaaagacacacagcccacatcttaaatgttgtctactgtttaagttactaaaatgatattaaaaccaccacaagtctctaatttttccagagtgcaattttacatctagtccccaaagattaaagtccaaatattaacattttcaaaagatcagtcctttgattgcaaaaatttttatcaaactaaaagttattaacgacaatgaacactaattaggcacccacaagagactgagaaggaagcccaaggactctgctctgcagaatcttctggtaggagatacaaagtctcaatccaggttgaagaacaccaaatctggtttccactgcccttttccatccccaggagcttgccaacatggtcccctgtggatctgacagttcttgggccatctataattccaggaaaagctcttgatcaatagcctcagcaaggcagaaacatccaaggttccagttgagacaagtatgaacaccatctgtcctagaatgaatctaacaaactcgggagccctacagcctcttgcaaaaccattctaatgaattataacaaaccaggtaaccacctttgttgtgttttgttgtcccacctatgcggtaagcttaagacccagacatctaaggaaatgttaacttacctctacagtcattcagcccttatcagtcacgaattcattcaacagacatctacttattgattacaacgtgccaaccctgggctaagctcctgagattcaaagataaatgtgagaagtttctatctccgaaggagctgactcttcagtagcagcctggaaaattaattcactacaattcctcatcgtcactattgtttggaatatattttattcccacattcaccataataattcaagacatagccaatagctttttcaatagccttaccttgtctaatctttctcctcttttaatctacccaacatttcattattttttccctgagtagctttattttccccctaaaagttcacacaaatcaaattaacatattgaatcataaaccatgaaactttctataagttatctgctcacctaactgcctcaatctatactgcacaccatcctaaaccgtgttttcctctccttcctaaaaaaagatggagacttatacttccatttttgtcccgatttactgcagggattttaactaactagtcagacttggttggttctgtttctgagaaatttgtttattctctctaacaatactaatcagcaacctgaactgtaagtccatataacatgcaagcttaactctgcagaaaaaggcaaaggaagcccagtagaagcctatggatcaagtacaactgagatgactatttcacccattaaacataaacatcaattaagtaggaaagcatataaactacattaataattttctctaacattaaacctataaatgtacatttattttatttaccagtcttacacaagagaggcaaaagtttttttttgcacttgagcccagtaattggagtaaaactacaggtgtataaactactcccatactgcattctctgtgatttctagtttgaggtccttcaagttggaatgagaacctaaagacacataaaagcaatcttaatgcagtaatagaatcctttcgggggtttgttgtattactttattcaatcttttattgttatcttgcccacatctatttttttcaacttttattttagatccaggggtgcatgggcagttttgttacctgggtatattgtatgatgctgagctttgcggtagaaatgattctatcacccaggtactgagcatagcacccaattgttagttttttaacccttagatccctccctgcacatctattttgacagcatattttaacaacttaatccttccaaactcttcaaattagttttgacatgaacaattctttctgtttttgtaactgtatgtcatcagtttaaacaatatttaattaaattacataattacaatggaaaaactagcataatcacattttgggaagaaatgcactgcctttgaggtaagcatgtaatttaactattggaagtatggggagcaaaagatgacaggtgtattcagtgtagcctataggtttattgtaacatggacatcattcaatgtgtttacagaagaaatagagagcgatggttaatacctttaattggttaaacagagcttcagtccttgctcttgaaacccttcagtctaataatagagacaggaaaagcgtctgtagcagggaggcaggggcactgctgcctttgcatggaggttaatttcctacttgctaagttttgttatgggatgaggctgtctcttctggttcttgtcctcacctaggtgccccagtcccctgacttctgtccagggggcttacaggtacccaggtttgttgaatggcctgtgtgcttcagtgatgagtctgttggggagtcagtcttagagagttggtcctctcctttgccccttcctctccaccctggtcctccagacctgttccttctgcagtatttttagttacttatttttagccacttatttttctcatctcccaggcccagtattatgtagtctctcttaagcagaaaaaaaaagttagtcctaaaataagccttgggagtttctttgaatctttgtttctactttgatgtggcacaaaaaacaatgttcctggagtgagaagagagaatatggaaaacacactgggcataacaagactaatacttcaaggtctaattctgccacacacaaatgcacatatataatttaaagggattgaaatatgtctgagattttaatagacaacatctctttaattttgtgcccctttatgatttatagaatatttacattgtatccctaagttcaggcctctgtattctttctatggcgatgataactataatttgagccttaacaaggaaaagtaacgggttagcacttaaatgtcatcaaatttaatttcttatcccattcaacactagtgcaaaatgaaaaaaagaaaatatctgtgttagaatcacaaaacaggccattaccttgttcatatcaaagcaaggattcaaatttgggtttgctctcaaaaccattaacctaatttattttagctggagaaattgaagactatatagtcttattaaaaagtggctactgctacttctgaaactacttttaaaaggaaatatagcttcttcctctctgacctttattaagagaagacctgaaaaatcttgttatgatttaatatttaattttttactattttcaaagcacagtggctactcaataagaaatgaacatgcataagagagactaatcattgagtacagagcatttagttctaaagaacaaattcaaacaaggcaacagctatcactacagaattattacagctcaggaaaccatatacactagaatgtaacctcattacagaacttctcaagaacaacatggattttactatttgtgcctaagataaaatcaaaattagtaagtccacaaaattagccaaatttaaagtttccctacatggtacataagccaccaaaaatgtttaagtctaggtatactttattaattagatgttatataattacaatatatttagagttttaagatggaaaagaaagactttctcctagagatcactcaaaaaaaaaaaaaaaaaaaaaaaaggagaacaagaaacgggaacaaaaaacctaaatttatccttaacaaaactggaatcttacccccaaccacgacctataaggaaggatatcatatgcaggatggcaaaacagggccatggaaagatgaaatgaccacagctacaaatctcacttgaagtcggcagctatcaattctccaaagtaactggcacatcccactaagtggggaatcagtaatcgcttgcttgaaacaatagcaacagatgagcttgctggtggccagaacttcccctggatgagtttggcacaaaggagaagcagattttatttttagtttacatggccaaaaggaaataattaataagagatatagatagatgtggagacagataaattcatcagaaatggttaagtggccattaaaaaaaaacacacacaaatacccaaaaatgataatggggaaaaaattaaaatttcaggaaaatttaaatgagattactttgctcaattctatgcaagtaaagttaagattataggtgaaacagatgatttctaagaaaatataaatggcaaactgaccttcaaaaagaaaacacctgaagtgactgtattcattttctattgatgtataacaaattatcacaaacttagtggcttcaaacaatacaaaataatcttacagtccttgggtcagaactccagcatgttttagcagagttctctgctaaggtggacatcaaatgttcagccaactctgtccttgcctggaagctcaactggagaaacctctccttccaagctggctctggttgttggcagaatccatttcttcatggttgtgggactgagcccccattgtcttgctggctgtcatctggagatcactttcagctcctagcagtcactctcaggtccttgccatgtggccccctccagggccctctcatagcatgacaacttacttcttcaaggccagcaggagaatttctctcacatttcagaaccttcaaagatcttccttgaggaaaggccaagtcccattttaagactcacttgttaggtcagacctatccaggaaaatttcccttttgatagaaccataattatatcttcaaaacttcttcaccgacttcatagaatgtcatctaatcacaggtttgaaatccatcatattcacagtcctttctatactcaaaggaaggagatgatacaagggcatgtatagtccagcgggaattttgggaaccatctgaaaattctgtcaaccacactgaccaatgaccacagaagaaggagaaaatcattaacaatctattttctccaaaaaaaaaaagcaccaaaccccattagttttttccaaacctttaaggagcacatactataatgttctaaaaaaactttttttctaaaatcagaaaagaaagaaattcttcaaattgaatataaaactatcacaatatttttaacaaagcttcaccagggtagcacaaaaaatagaaagtgatggtatattttatttataaatactcatactgaaaaatggtaatcataaatataatattacacaatagactagctatttaaagactatacatcaaattaagttgagctttcacaggtatgtttcaatattgggatacgtattaacaaattcaccttaatagtaaattttaaaggttatcatcatctctacagataacataaaagcatttgataaaatttgcaaactgcttttgcaaaatacttaatacagtagatcccccttatccatgtggatacattccaagaccccaaatggatgcctgaaaccatggatagtaccaaatctgattgctgtcggttggaacatgtttctgttccggtcctccgtccacaaatgtaatgcctttcccatcctaactaagcacttaacatgcactgtagctataacttttgcagtttaaggtgtgacagtaaaactagcatgaatttctttttcctcctgcacaatttcatgggtagatttgttcttaggatagatcttagcacctcagcatatgactttttttctttccttattaagtcaagaactgtcaccctttcacttaaaggaagcactttacagcttctctggcacatttcagttgccagagtcatcactcttgcatttgggggccattattaatcaaaatatgagttatttgaacacaagtactgcagcaatgtcacagttgatcttataatcaaggctatcaggtgaccacaggcagacagtgtagctagcatggaaatgctgggcagaggaatgacccatgtcccaggcaaaatggagcaggaggatgtgagatttcatcacactattcagaacaacacacaatttaaaacgtatgaattgtttatttctagaattttctaacaatattgttggactgtgcttggccacaggtaactgaaaccatggaaagagaagtcatgaataaagaaggactactgtatttagcatgattaaaatataaatatgtgtgtttgtataatggatatatttcaactgaaaagctatctattttcttaatgagaaaactctaggaatttttccattaaattattatttaacattattttatattattctgaagatagtaggcaatgcagttagataagagataaaaatacgatataaaaattagaaagcaggggggaaattttctattaggtaatatgacctgcctaaataatgcagtgaaatcaactaaaaaatgactataaacaataagaaatccagtaaattgcctgggtaaaatatgcatgagcgtgagtgtgtgtgtgtgtgtgtgtgtgtgtgtgtatttgtaaatatatggaaaacaatagcctttataaatataaaaagaaaccacccaaaggatgaaaagaaaaaaacaatttacaacagtgaaacaaaaactaggaataaatttaagaaatgtgcaaaactctgtcaaaaaatgttataatctactaaaggacacaaaaaaagacttgaaaaaaataaaaatttataaagaagattctccctatgtatactcataaatttaaggcaatctcagtaaaaatggtaataatttttttagctaagctaagtgcttctagttcataagaagaaatagaataataagaaaattttggagaaaaaatgataaggggctaatcacaacaaataataaaatacataataaaactagcctgaataaacacagatatctatagcacaaaagttaaatggacccagataaaaatgtgaagttaacataagataaaattaacatttcaaatcaagacggagacaatagtttcctcagcgatagtacagaacaactacccattttgaagaaaaaaaaattgaatcccacacttcatacaaaaagtatgaagatcctaagaagacaaatcattttaagcattaaaaatgacaaaaaatataattacaaaagttacacaagaattagaatagagatagtctcctaagtgtgttttaaaaaaaaaaaaaaactagaagcaatcaacgaaaaggttaattcatttacataaaatattatgtgaaaataaaagtcaaatgacaatctgggaaaaattatttgcacctaatacccttcataaataacgatctctcataaatcaacaagattaagcatcatttttaaaaggcaaaatattgcaacagttcacagaaatgaaaatacaaataactcatccattgaaagttattgattctcaattatgataagaaaaatgtgaattaatattataatgatagatttttcacttatcagatttgcaacaatcaagaactttgatagcaatgtgttgttttagagaaatagacactttcaaatacagtcagtcactgtagttaaaagtggtacaacctctagttggaacaattagaaaatatgtttcaagatgtaaaatgtgtatatgtgttggctcaacaattttatttctatttacataaaccaaagataaactcacacctgtgtgaaatgacacatatacaacacatgtatctcaatattgttcttatggatggaaaaaatggaaaacactaaagatttatcactaagggactgattgaattaattattatctacctatgctatagattacagtatagtctttaaaaataatgtaactttatttttactagtatggaataatatccaagtctattggtaagtgaaaaaaaggcaaagtatatagaacaactgtgcaaaaattaaaatgaagggaatacaaatgtttttatttatattgaataatttatatataaaacatatatagtatatgtgaacatatttataagacaaaattaaaatagtttcatatgcagacaatattcatagatgtcctcatgaatccaacaaatatttgtcgaaagcctattatgtgaaaatgacattgctattgaaaataatataatattataatctgcaggaatgacaaggtctctaccttatgaaattgagtgccaaaaagattatacataaacaaacatgatcatttaaatcagccagtattacaaggcaggatgcccataatatagaacagttataactgaccacataattgacttggtatttatatgccaaggtggaagaggatagaatgggctgtgctatttcctggcccccatttctcacacattaaacccaatacctggctcaatatgcattctctgttggcccctgaaggcccctgacttttaagatcctcttaatggaaggaatttagtttggatggtaagaaaaaccttttaaaatacatctatatctgcattcatgtgttaatatatatttacatgaatctcacaattgtttaaatacaaactctagaaacaaatccaaggtattgattaggccaaaacttccaagctaaaggaaggactttggtccactaggaaatccctgagcaaagagaatgagcgatttgttgaatagtgttctctgcatggcatcccttccacaggtgtggatcccagggtagcttcttttcctcaccccttacacctccaaccttgagtctctctcatccagccatcaccaaagcactgtttgcagtgaatgttccatatgttacacaactcacagatttgtaggagaaactacaaaacatgacacaccggcatcctaaagaaaggggttgtttctgggcccttgtccccaagccgggtcattggcccccagcctccacacttgctaacttgccaaacacttggttcccaagacaaaccactgtcaaagaacctcagtattaattcataagcattttcactttctccatagttgtctgaaaatacaaaagccccccagggtgtttaacttatactcctaaagtagttcatttgactccctggaagggtaaaactcaatctcattttacgattttacactttttcccttaagccatctctcattaaactatcatgacaatgctttgtacacatggttttgttagaaataaattcagccttataaaatgtgctcattggaaatcctttttatgccaaggatgattctaaaatattttatataccttctcattgcttttatgagacagttgtattagagaccactccttacttctgagcttgcaaagtaagtcaaagtgtagttgcatttcatatctaaaatgtgacagaagcctttctgtggcacatcacatgcccccagatacacaagaaaatatctggaattgttcctatggaattttttcctacagtatttagcctagatgacattaaaatatccattttagttcaacatgcccagaattgatcttccaaagaaaatattaaaatgactctaaactcattcagaaactcaaagataaacagaaacagctgctaaatgtctcaccagccagtctgagattcatttcaattacccaacaaaagatacctcaggtgtatcagagcactttcaagttaaattttatgtctattagatataagcctaggggcaattatgaattccttccagttgttccttcctttatgtctaatggcattttcctaattccctgtttaattttattttagcttttatagatagttgtaaagtgagcaagctgtaacagtttacatggcattcagtacctgtggtaaggtcaatttgacttcctatagaaatctttttaatgttgagatttttttccaaagttttctatttttctggttgccattttcctctaacaagaaaaatgaaatataatctaatcatgctaatgcttctaacacatcaatctatataaagcaagtcagtttgccccccacacaagaggtatttgtacagaaagtttcaaaataaaacacctcttcatatagttctcaagtccttcacccaaaaccaaataacaatattattgtgagccttcagagtgtatacacacattcactttagaggtataagaatttgatttttggttccaagatggccaaataggaacagctccagtctacagctcccagtgtcagcaacgcagaagacgggtgatttctgcatttccaactgaggtaccagattcatctcactgggacttgttggacagtgggtgcagcccgtggagtgtgagccaaagcagggcaggacatcacctcacctgggaagtgcaagaggtcagggaattccctttcctagacaagggaagccatgacagacggtacctgcaaaataggacactcccaccctaatactgcgcttttccaattgtcatagcaaatggcacaccaggagattatatcccatgcttggctcaccaggtcccacgcccacagagccttgctcactgctagcacagcagtccaagacccaactgagaggccgcagcgagggtgggggaggggcatctgccattgctgaggcttgactaggtaaacaaagcggtggggaagcttgaactgggtggagcccagcgcagctcagtgaggcctgcctgcttctgtagactccagctctgggggcagggcatagctgaacaaaaggcagcagaaacttctgcagacttaaacgtccctgtctgacagctttgaagagagcagtggttctcccagcatggagtttgaggtctgagaatgaacagactgcctcctcaagtgggcctctgatccctgagtagcctaactgggagacacctcccagtaggggccgactgacacctcatacagccgggtaaccctgtgagacaaagcttccagaggaaggatcaggcagcaacatttgccgttctgcaatatttgctgttctgccacctccgctggtgatacccaggaaaacagggtctggagtggacctccagcaaactccaacagatctgcagctaagggtcctgactgttagaaggaaaactaacagacagaaaggaataacatcaacaaaaaggacatccacaccaaaatcccatctgtaggtcaccatcatcaaagaccaaaggtagataaaaccacaaagatggggagaaactagagcagaaaagctgaaaattctaaaaatcagagcacctcttctcctccaaaggatcgcagctcctcgccagcaacagaacaaagctggacggagaatgactttgatgagttgacagaagtaggcttcagaaggttggtaataactaacttcttcgagctaaaggaggatgttcgagcccattgcaaggaagctaaaaaccttgaaaaaagattagacgaatggctaactagaataaacagcatagagaagaccttaaatgacctgatggagctgaaaaccatggcacgagaactacgtgacgcatgcacaagcttcagtagccgattcaatcaagtggaagaaagggtatcggtgactgaagatcaaatgaatgaaatgaagtgagaagagaagttgaaagaaaaaagagtgaaaagaaatgaacaaagcctccaagaaatgtgggactatgtgaaaagaccaaatctacatttgattggtgtaccttaaagtgatgggaagaatggaaccaagttggaaaacaaccttcaggatattattcaggagaaattccccaacctagcaaggcaggccaacattcaaattcaggaaatacagagaatgccacaaagatactcctcaagaagagcaaccccaagacacataattgtcagagtcatcaagattgaaatgaaggaaaaaatgttaaaggcagccagagagaaaggtcaggttacccacaaagggaagcccatcagactaacagctaatctctcagcagaaactctacaagccagaaggttgggggggtggtggccaatattcaacattcttaaagaaaagaaatttcaacccagaatttcatatccagccaaactaggcttcataagtgaaggagaaataaaagcctttacagacaagcaaatgccgagagattttgtcaccaccaggcctgccttacaagagctcctgaaggaagcactaaacatggaaaggaacaactggtaccagccacttcataaacatgccaaattgtaaagaccatcaatgctagatagaaattgcgtcaactaatgagcaaaataaccagctaacgtcataatgacaggatcaaattcacacataactatattaaccttaaatgtaaatgggctacatgccccaattaaaagacacagactggcaaattggataaagagtcaagacccatcagtgtgctgtattcaggaaacccatctcacatgcagagacatagataagctcaaaataaagggatggaggaagatctaccaagcaaatggaaaacaaaaaaaggcaaggattgcaatcctagtctctgataaaacagactttaaaccaacaaagatcaaaagagacaaagaaggccattacataatggtaaagggatcaattcaacaagaagagctaactatcctaaatgtatatgcacccaatacaggagcacccagattcataaagcaagtccttagagacctacaaagagatatagacccccaagcaataataacaggagactttaacaccccactgtcaacattagacagattaacgagacagaaagttcacaaggatatccaggacttgaacacagctctgcaccaagtggacctaatagacatctacagaactctccaccccaaatcaacagaatatacattcttctcagcaccacatcgcacttatttcaaaattgaccacatagttagaagtaaagcactcctcagcaaatgtaaaacaatagaaattataacaaactgtctctcagaccacagtgcaatcaagttagaactcaggattaagaaactcactcaaaacctcacaactacatggaaactgaacaacctgctcctgaatgactactgggtacataatgaaatgaaggcagaaataaagatgttctttgaaaccaatgagaacaaagacagaacataccagaatctctggcacacatttaaagcactgtagagggaaatttgtaacactaaatgcccacaagagaaagcaggaaagatgtaaaatcaacaccctaacatcacaatcaaaagaactagagaagcaagagcaaacaaattcaaaagctagcagaaggcaagaaataactaagatcagagcagaactgaaggagatagagacacaaaaaaaccttcaaaaattcaatgaatccagcagctggtttttcgaaaagatcaacaaaatagatagatggctagcaagactaataaagaagaaaagagagaagaatcaaatagatgcagtaaaaaatgatgaaggggatatcaccaatgatcccacagaaatacaaactaccatcagagaatactataaacacttctacgcaaataaactagaatatctagaagaaatggataaattccgggacacatacagcctccaaagtctaaaccaggaagaagtcaaatccctgaacagtccaataacaaggtctgaaattgaggcagtaattaatagcctatcaacaaaaaagtccagtaccagatggattcacagccgaattctaccagaggtacaaagaggagctggtaccatcccttctgaaactattccaaaaaatagaaaaagagggaatcttccctaactcattttatgaggccagcatcatcctgataccaaagactggcagagacacaacaaaaaaagagaattataggccaatacccctgatgaacagtgatgcaaaaatcctcaataaaatactggcaaactgaatccagcaatacatcaaaaagcttatccaccacaatcaagttggcttcatccctggaatgaaaggctggttcaacatatgcaaatcaataagtgtaatccatcatataaacagaaccaaagacaaaaaccacatgattatctcaatagatgcagaaaaggcctttgacaaaattcaacaacccttcatgctaaaaacactcaataaactaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaatttctggccagggcaatcagacaaaagcaagaaataaagagtattcaattaggaaaagaggaagtcaaattgtctctgtttgcagatgacatgattgtatatttagaaaaccccattgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatcgaacttacaagggatgtgaagaaccgtttcaaggagaactacaaaccactgctcaatgaaataaaagaggacacaaacaaatggaagaacattccctgctcatgaatagaaagaaacaatatcgtgaaaatggccatactgcccaaggtaatttatagattcaatgccatccccgtcaagctaccaatgactttcttcacagaattggaaaaaactactttaaagttcatatggaaccaaaaaagagcccacattgctaagacaatcctgagcaaaaagaacaaagctggaggcatcacactacctgacttcaaactatactacaaggctacagtaaccaaaacagcatggtactgttaccaaaacagagatatagaccaatggaatggaacagagccctcagaaataataccacacgtctacaaccatctgatctttgacaaacctgacaaaaacaagaaacggggaaaggattccctatttaataaatggtgctgggaaaactggctagccatatgcaggaagctgaaacttgatcctttccttacaccttatacaaatattaattcaagatggattaaagacttaaatgttagacctaaaaccataaaaaccctagaagaaaacctaggaaataccattcaggacataggcatgggcaaggacttcatgattaaaacaccaaaagcaatggcaacaaaagccaaaattgacaaatgggatctaattaaactaaagagcttctgcacagcaaaagaacctaccatcaaagtgaacaggcaacatacagaatgggaggaaagttttgcaatctactcatctgacaaagggttaatatccagaatctgcaaagaactcaaacaaatttacacgaaaaaaacaaacaaccccatcaaaaagtgggcgaaagacatgaacagacacttctcaaaagaagacttttatgcagccaacagacacatgaaaaaatgcttatcatcactggccatcagagaaatgcaaatcaaaaccacaatgagataccatctcacaccagttagaatggggatcattaaaaagtcaggaaacaacaggtgctggagaggttgtggagaaataggaacgcttttacactgttggtgggactgtaaactagttcaaccattgtggaagacagtgtggagattcctcaaggatctagaactagaaataccatttgacccagtgatcccattactgggtatatacccaaaggattataaatcatgctactataaagacacatgcacacatatgtttattgtggcactattcacaatagcaaagacttggaaccaacccaaatgtccatcaatgatagactggataaagaaaatgtggcacatatacaccatggaatactatgcagccataaaaaggatgagtttgtagggacatggatgaagctggaaaccatcattctgagcaaactatcacaaggacagaaaaccaaacaccgcatgctctcactcataagtgggaattgaacaatgagaacacttggacacagagtggggaacatcacacattggggcctgttgtggggtggggggaggcaagggatagcattaggagaaatacctaatgtaaatgatgagttaatgggtgcagcacatgaacacggcacatgtatacatatgtaacaaacttccacattgtgcacatgtaccctagaacttaaagtataatttaaaaaaaataaaataaaataaaaaataaagaatttgatttttatattctacatcaaggtcagcagcctgtaacacataaggccaacagaagttaaccagtactcccttttcctctccaaacagctgagaatacatataatgccttccttcccccaacacacacattcacagacctgcatgttatcatatgccctgactcctctcatggaggccaacatgtggatatacatcaaccacctcacgtaacccccaacataccggaaaaataggctgtccactaggtagactatatcgtgtaatcaccattcttgagtacctataatgtgcctcctccagatgctgtgtgtattatttaatttggtccttacaaccacctatgaagtagatacattaccccaactttatggaagatgaccctgagactcagaaaatggtggaaagctgcccaactgaagctcggttcactgtgccacattgtgaaagtgtatcaacttttcctagagatagaaataatttgcaaacaccattataaaccttcaagagtttcacattttttattttggtgaaaacatcttcatatttaatattgcttaaaaaactaacaaaaaaatttaaaactgaatttctctttgattctttgaggcatttattgcaatgctgttcatttgagtagcatttgactgagtgcttgttctaaagtgcacccttggctcctagaaacccaaaccctcactgtttacgaaaagagtttttaaatgtggatatttgacttgcaagaagacagaaacccacctcattttaacttagaagaaaggaagaattcgggaggaagctcgtggaaacggtgcaaaagtcaggaaaatggatgagtctcttggtggcctgagggcctcaagtgctgctaggacctttgctctgaatgtctccccaccatgcctctcagtgtccatttcattccctctcacggactcccctcctgcccctcaggcatggccgctgaaagctctcgggctttcattttccgcttcaccaccagagaggtagttccagccaccatgatgaaacctcagagaaggacttcaattcacctggcctgagtcatgttcccacccctgccatcaggacatggcaagattgacagcccaagtgagcggcaaaggaaaagcctatttgaatatttttgtaaaagaaggaaggttctgttccactacagaaagtcaactttttaaaaatgtttttaaaactttgattatatttttagcagatggtgaatccagaaaatgtaagcaataaactcaaattctggagacatatggaaatatggtaaaaagcaggtgctttgcctctgatgtaaattctaagctgcagaataatgaattaagggaaatgacaggttaggtccttaattacattttacccaaagaagcactcttcagatgttcaaatccagtttttcctccccaagacttaaagttttgaataaacattaagtgatacatctgtttttaagtttcattccccgcccccaaatcgctgtttttaagactgcttaatgttactgtagaaatgaacactttcttaaaagtagtgatcctgtgaacaatgtaacctctgaagctcttctgctaccactcaaacctctagaaactcattaaatgcaagattgaccacattttttatactgacacaacagagcatttctgacttagaaaaaattctaagcagataactcaagaaattagggaattttcccctgaaaataaaaccatcatattctcattatagactataaacacatttctaacttctacttttatttcattctgatcaacaaatagaaaagggggatcaggacaagtcaaaataagctgttctttttttctcgctatctcagagaataacctcaaaatccagatttctgtgaataaaggaaagcaatgctttgtggaagtgtatcttcccaaagttaccctttttagatgtagttttattacatctagcccagaaaagtagtttaatgatagccatagcccttttcaaaatctatatcccaaagcttttcaggttaacaatattttaatttctagatagatggtaaagtgcttgactgtctagtcttaagaattttttcaaccttaccctgcctaagttataccatacaattaggaagttattttctggtcctagaaatttaagtatttatttatatagagagtgctgtatttttaacatcactcatttctttaatttataataaacaactagtgaatgaaaataagctcaaaaaagcttattcccttgaaatttacatttgaatgtattatgatcgtagctgttatttttaatggcagctagctacagagtgagttatcattaagtaactcagttgtctggaattaacctgactttatattaataaaccaataactcattcattcagtcagtcaacaaatacctacagagtaccatgtgtcaggcactgttaaaggtgcttaggatacatcacttaatgaacatagtaaataagtgagatatctactgagttagaaggtgtgagaacacaggcagaaaagggtgatgagtactgagagtataggatggatcaaaaggatttggagctatgacttgaaggagatgagggaactaggcatgtggagttctgcaagaagagaattccaggcagaagaaaccgccaagataatgcccgagggtgacagagtatctggcttgtaggaggaacagaaaagaagccagaatagcttgggcagaaggagggaaggaaagaagcataggaaataagattagagagatagccaattttggggctgaatgcttttaataaatacttttttgagaatttgaattattatttccataaagtgtattatgcttcatcttatacctgatcatagtgctcccttattgtcctcctaataaccagtttcttattgaaactaatttcatagttcatgtgaccagtgtaactgtatgattctattgaatttaacattctctatgtccaaatttcaggttgtggctgatatagaaaattgttttaaaaataagacaaacatttaattattccatcaatttgaactgcattatgacaaaagaaaaaaatgccaggccaggcacagtggctcatgcctgtaatcccagtactttgggaggccgaggcaggtggatcacttgaggtcaggagttcaacaccagcctagccaacatggtgaaacctgtctctactaaaaatacaaagatcagctgggtgcggcggtgggcctctataatcccagctatttgggagcctgaggcaggagaatcactttcacctgggaggcagaggttgcagtgagccatgatcgctcactgcactccagccagggtgacagagcaagaccttgtctcaaaaaaaaaaaaaaaaagcaaagaaaaaatgcatgtattcattcacaggtgaaataacatttcttcaaaatatttatgctgtcaaaagaagacacattatttgcaaatgtaaaatatttctctaagagttaactactaaagtatggagatatggtttgactgtgtccccacccaaatctcaacttgaattgtatctcccagcattctcatatgttgtgggagggacccagggggaggtaattgaatcatgggggctggtctttcccatgctattctcgtgatagtgaataagtctcatgagatctgatgggtttatcagaggtttccacttttgcttcttcctcatttttctcttgccaccaccgtgtaagaactgcctttcacctcccgccatgattctgaggcctcccctgccatgtggaactgtaaatccaattaaacctccttttcttcccagtttcaggtatgtctttatcagcagcatgaaaacggactaatacatatggcatgccactttttttagactatcatcacatcatactaccaaaaatttcttttaaaaatataatccatatctttcagaacaaatatagaatttaatacctgccacaacagtgtgctttcctaaggaatcatgttcccacactaatacctaaatccatctactctatcagaatgtgaatgcttctactgaaatgtgcatagttattggcagactgaaaaaaaaataaagtagtgcatagtgatatccaggggatagagacaaaaacaactctaagattagagatagtggaagcagtgtgctatggtaaaagtaagggggccctgaggttgtgtgaagcaacactaaattagaaaagccttagggacttccacataagtagaagcactaagtataattgaaagaagaagccaccatattcacctactccacaaatatttattgagtgtcttctatgtgctgaacccttcaacagtagctggagatataatagtgaaaaagaaagtcatggaatttatagtctggtgaggggaggcagatgctaagcaaatcatacaggtgcactcaaagaaatcatttcattacagttatcccaagtgttattgttagagtaggcagatagctaggcatgagcaggatggggagaccctgaggaaatggaggtctagaaaaatctcacacctcagagatcaccagaaacaggtaggctagttataagcagagaggaggggaaacacctatgcaggaaggaccgctccttaagagacccagtaatcatctctttgcagttaacctgccaggatgtagctaggtgtgtgctgacaaggaggggaagagagtttattagtttgttttcatgctgctgataaagacatacccgacactgggcaatttacaaaataaagaggtttaatggacttacggttctacacagctgggaaggtctcaggatcatggtggaaggcaagaaggagcaagtcacatcttacatggtggcagggaagagagaacttgtgaggggaatccctctttataaagccgtcagctctcataagacttattcactgtcatgagaacagcactggaaagacccacccccatgattcagttacctcccactgggtccctaccactacacttgggaaatgtgggagctacaattcaagatgagatttgggtggggacacaggaaaccatatcagagggcagagaaattcctaagaaatacgcaggtagaataagtatagatctgacctctatacaaccttcctgggatggtgctaatgagcaatgcagccactaggtagacttagtatccaacactgccccatgtgtgcacaccaaggggagtatattagtctgttttcacactgctgataaacacatatccaacactgggcaagttacaaaagaaagaggtttaaatggatttacggttccacatggctggggaggcctcactatcatggtggaaggcaaggaggagcaagtcacatcttacttgaatggcagcaggcaaaaagagcttgtgcaggaaaactccccttatagtaagcatcaaatctcgtgagacttactaccacgagaacagcacaggaaagacctgcccccatgattcaattacctcccaccgggtacctcacacaacacgtgggaattcaagatgagatttttgtggggacagagcagaaccatttcagggagggtcccacgagcctggggtgggaactaggcagggaaaggtaagggacttaaggcagaagcgggaaaactagacaaagaaaaaaggtgatgacttaagacagaggtgaaaacttcaagaaaaaatccaacatcataaaaacccaatgcagaactctcagggtgcgcctggcccattctctttcagcagcccgctctgcctcatctttcacaatgtcctgtccctttaaataaactctctgctccctctttcccttcatgtaaagttttctgctgtgtttgaactggccaaaacctttctcctaagactataaacgactgaggattcccgcacttccgggcaacactgtctccaattgaaagaaggctccatgtgctcaaaactttaagtgggtcacacattagagcttctgtctgggacggatgcttggcacctagtgagtgctcactacgtatttgttcacttaacgaagtatatgaaagagaagcacaggatagagtgagagcatgaaacagggaatcccaaccaaatctgggggctcagtgtgagttaagctgaaatctggaaaatatagagaagacaaggaataggaaagaaggaaagggaagaggagaaggtgggagaattttctttggagaaaacaactgatggcagcaagctctgaggagggaaacctgatccttcctaaggaattaaaaatagctctggccaggggagtgggaaggtagtgactgagagacaagtaggcaaagaccagatcctgcaaagtcttggaacctttatggagcagttgtaactttgccctaagagcagtagaaaaccactgaaggattttgatagaggaatggtatgctcagatttatgttttttactgttttgttttttgttttttcgagacagagtttggctctgtcgccaggctagagtgcagtggcgcgatctcggctcactgcaagctccacctcccgggttcacgccattctcctgcctcagcctcccgagtacctgggactacaggtgcctgccaccacgcccggctaatttttttgtatttttagtagagacggggtttcactgtgttagccaggatggtctcaatctcctgacctcgtgatccacccaccttggcctcccaaagtgctgggattacaggcatgagccaccgcaccaggcttatgtttttttttttttttaaagtgatcatggggccgtaagaaggaaaaaaaaataaatcgcaggattctatagttttctcaacactgaatttagaatttaaaaagtctgcccagaagtttcttgaatttgacttaactacacagagaaacttctgaggggaagaattttaagaaccaggatgaggttatcgatagaagacatgaattttgagtccttggaaatggtagtaacagaactctaagatgactctcttccttggtttactcacatgagtatgtcaacgttacatggtaaaagagatttggcaaacgtaattatcaatcagttcactttaagaagaggaggtaatcaaggtaggcctcatctagtcacatgagtttaaccactgctgggatggaaggtctgtgaagcaaggaactaaaaatggtgtcgataagctgagaatggtccccagtcagcagccatcaagaaaatggggatctcagtcccataattgcaaactgaattctgtcaataacctaagtaaacttgaaagcagattcttcccctgaggctccaggtaagagctccacccagcagacacctagacttcagccttgtgagacccttgatggagaaccttgttgagccctcatggactcctgacctacagaactgtgatacagtaaatgtatgttgttttaaacaactaagtatgtggtcatctgttatgcacgtacatctgtaaacaccatgttagagtgaccctctgagaataattagttgaaattttattactgtgtgtttattaggttgttttgctatatcttaagaaggaaagagtcttacttacccatttgggctgctatagcaaagtgctacagactgagtggcttataaataacagaaatttatttctcactgttctggatgctgcaagtctgatatcagagtgccagcattgttgggttctggagagggccctctaccaggttgcagactgccaactactcattgtatcttcacatggtggaaagaccatgagagagctctctggggtctcttttactagttcactaattctatccttgagaactctaccctcataacttaatcacctcccaaggaccctacctctgaataccaccacattggagattaaaatttcaacatttgaatttgatagggtggatggatacaaacattcaatccataacagaaagcaataatgatttattgaactttctattacggcacttttcattccgcaaatactctcctaagatgcatttagttcacttctgctcactttgtaagtattttacaagataacattaagtgaagaataggttaaggccagaaaatgtaaggcattgttccagaccttgaccccacatcttgtcctcacttatcaccatctcctagtcctgcaggaaagattggccacctccacaagctaatcaatattgtcacttttttgtgaaaaacaaaaggctgtgccaacaaattcctatctcccagctgcagatgataagaaagtttctttgccttgacatttgcttatctttgaccaataagcactgacatttgattatacactggactatccagcattctcctccctcccatttcccaccctaacacctgctgtctaattacttttaaattctacctctttaaaatgcaggagtaagaattaaagtaatctctcaaataattacagtcactaaatttgattaaaaatatcagaagaggctgagaaaaaaatgactgttcattagggtggaacaacatctataataaatccaaaatcttggtaatttaacattaataagaattttctattgcttgtctcacaatttggaggaggaggcatgagcaatgcttcacccagttttcagcaaccccgtccccatccatttaatgattctaccatctgctagggcctcagaatcctcctctgtatcttctgcaattactcaggctctgagggaaaaatatattataaataaggtagagaaagtagtccacttgtaatttctttggcccagaggtgatgcacatcacttccatttgcatttcactgtcaagaaacaattacatagtcacatctaaatacaaaggagctgggaattataacttggctgtgtgcccaggaggaagtgagcatggaaattgctgagtcctagctctgtatcccgtacaatagaataagatgaaatctatgagtgatccataaattttggttatcggtgttagtaattcacctttatcatggatttagaaatatgtagttccaattactactgttgcataacaaagcttagcaccataaagcaactgttttattaagcttttggattttgtgggccgcaaattcaaaaaaaggcacagaggagatagtttgtttctgctctgtgatatatggagtctcggggggatgattcagcagcaaggggctggaatcacgtagaggcatctttattcacagtgctggcagctaatgttggtcatcagttaaaaccccaagtaaaggtatttacccaatgcatgacatctcaggtccttggactttttcacaatggagtagcctcagagagtcaaatttctcacatggaagcccagagtttcaaaaacaaatgccccagaggacaggctatgtggccttttatgacctatcttcaaccacttctgttgtactctactggtctaagaattcataagcccaccctaattcaaagagaggagacatagaccgatcccctaatggaaagttggttaccgaggtcacattgcagaggggtatgtgcaatggaagatattgtggtgtctaattttggaaactataatctcccacatacattatcttagaatcactgaaagttagtgtttgaaaggattaatttctttatagaacaagagccagcaaacaatagtccactgccagttttggtaagcaaggtttaactgaaatacaccatgcctatttgttagcagatttgaggagttccaaaagataccatatgacctacaaaggcaaaagtatttattttctggccctttacagaaagagtttgcataatctatagatacaatatcaattaaacacgtggacactgaagttagactactaggttttcaaatctcagttctggaagtggccagttatgtggctttgaacaagctacttagcatctctaggctgccattttcccaccttcataattggggaaacagtaaagtctgtcattgaattgtgagcattacatgaaataattaatgaaaagggcataattagcattcataaatgctaacttgtgctgtagaattgccttaaattatcagctagatcaaatgtccatttgagtcatatgtttatctccagtgtcatctgctgcagatttcaacacatctagtgatacaggaagtccattctatctttaatcattttattagaaatttcttcctactaggttgaaatctgcccccttacagctatatgcaattaatcctggttctatctcctaaaggctctacaaaacatctcttccaaatattgggttctttgaaaaggctatctctgaattttatcttatcagaactacacatctttagttctttcaattgcctctcctaagacagagttcacatcacttttcaactttaaaattccccttagaaggaaatataaagcatttatccagaaattagcaaaagacttcaggcctgcagatagatctagatcgttggtccctaaattctccatagtatgttaatgatgtgtgttttgtgctactcagtctttttccacacttcctgctgtggaagagttgatttcttaagatcctgggacaggtgtttattgttgcctttttatgttcaatgttatagagctccagcctgtggagatctttccatatgttgataatgtagtttagactgtccactgcccttaccagctttatattacccacacatatttctgaaggcttgatccaaatcgttactaaatatcccatcaagttgaaattaatactatgagtaatcctgaactcaattacagcaactgaatgttgctttaataattgcacttattccttcctggacttccattgaccttaatcaccatttgttcaaccattctcgcttgggtgacattcctcttagtgaaagaagttggaagcaaatataaaggaaaacataagcatttctctttctctctttcaatattacacttcaaatcaagatatgtatctgtattactcaggggtctccagagaaaccaaaccaagggaagagagagattaattttaaggaattggtccacacgattgtggaagcttggtaagtccacaatcttcagagtaggtgggcaagctggagactcagggattctgctggcagaattccttcttgctcagtagaggtcagactttgttctattaacaccttcatccaattggatgaggcccatcgacatcatggaaggtaattcactttactcaaagtccactgatttcaaatgttaatggaatgcaaaaaacaccttcacagaaagatccagaatagtgtttgaccaaatatctgggcgccatggtccagccaagttgattcataaaattaaccatcagagtatctctttttataatcatttatcttacaataaaaatagctaagactatagcctatatgaagcctggatttatgttttgataattagttcttttataatagaagatctgttatataaaaccacaattaagtgtgcgtctgtctgagaaggttgtcatggtaaaatataaccatgacttttgttactaaatataaaagtacagcatctagggccaggtgcggtggctcacgcctgtaatcccaacactttaggaggccgaggtgggcggatcacctgaggtcaggagttcaagaccagcctggccaacatggtgaaacctcgcctctactaaaaatacaaaaaattagctcagcgtggtagcgggcacctataatctcagccacttgggaggctgaggcaggagaattgcctgaacacaggaggcagaagtttcagtgagctgagatcacaccattgcactccaacctaggcaacaagagtgaaactccatctcaaaaaaaaaaaagtacagcatcttaactgattattttctgtacctaagaaaaagatcagtggcggggggagaaatgagaatgcaactctgatttttaaggttagcactgttgcaagtttcagaatgcaacttaaaaggtatgatatgcttgtgttctttaaagcattcacctatttttaaaatttcactttttatatgttaaatttttaaattggcattttaatttcaaatgttatttcttcaaatgattttacaagattattgaaacaaatatctatataaataagatgtctaagcatgaaatgtgggttcaatacaatatttgtaacaaaattttactagaatttttcttaagccaacatgttgtctatggaaacaggattttattgaactagtattttagttttggttttgttttgttaagacagggtctcgctctgttccccaggctgaagtgcagtggtgcaaacatagctcacttcagcaagccattcgcccaactcagcctcccaagtagctgggactgaaggcgcacaccaccacacccagctaatttttgtattttttgtagaaatgtggtttcgtcatgttgcccaggctggtcgtgaccacctgggctcaagtgatcctccctccttggcctcccaaagtactgggattataagcatgaaccactgcactcagctgtattttggttttaaacttttatgaatctaggttttaaaaaaaagtggttttcttttctggttagccatttataataagtagaaattattgatttaaagacttttagagattttaagatggtttatgagtcctactgattattcctttcttgtgtgaaattcactgttgtcttttgttctatttttccctcttcaggtttggatgtgtggaggagaaatgtttgatgttccatgttctagagttggtcatatctacaggaagtacgttccatacaaagttccatctgggacaagcctggcaagagtgagtaactcagcatcagaacagactggggttgatatggctttctgtaaccagagtaaccaaccttgcccatggcacagtctgagaaaagctctccagtgtacagagagctcctgtgcttctcagagtcttatttccattgcttaaagaagtattaactataatgctatttcttgttacaaattggttcaaagcattttcacatacattatatttaatcttcaccattaccttctgaggtctgtgttcttgtctttattttgtagatgggaaaatgaagtctgaactaggtgcttgttcatgctcacatgaatgccaaatagcagagtaggtccgcggacctggggcagccagttctctccacccacatggagtgtagcaggatctgtaataagtcagatggaaaaaggggtaaatgggagatgggaaaaggtggatgtccaaactctgccttcttctctttcataactagggccagctctgcctcaaattttgccccatcctcaacatttcaaaattggctcagtcttaagatttttttccaatattgttttgaataaaacctttcttgtaaaccagatgcaaagatgctcttctcttctgccgtttgaaacatttttatgcttgtttaggagaacggactcacaataccatctccaaataatcctgacaatttctctgctttccatattactttcttcagggctgggtcagtttttgtcaccaccatatgtacctgctactgctgagaatcgaaatctagaaaaagagaattttatcacactgctaccctagaaatcaaatcctgaattattcattttggttcttttactaataaggctgcaagatataactatttggatcttttatataaggctcacataacaagcttttgtaaaaataaataaacgaattcaccaggaatcattagagtatcagtaacacaagggtagagctttggtctgtgttagttaccgctgtactctcagaacctaaaacggggcttagggaacactcagatatttgttgaaagaattaattaatcaggaaagctaagagaggaaaatgctggagatttaagttgttactaaaacttaaatactttttaatgagtataacaaaattttcttttacagtgaatctttgtggggcggggggagttgttcttcctttttccctttctgagagtattcatcaactgtccatttctctttagctacatccatattctctaacagcaattagagctcctagtaataacattaccttacacacaccttgaatggaaatacaggctgagtatccctcatccaaactgcttaggaccaagagtctttcagatttcagattttttccagattttgggatattcacatatacataatgagatatcttggggataagacccaagtctaaacacaaaattcatttatgtttcacatacaccttatatacatggcctgaaggtaattttatacaatatttttaataattttgtgcatgaaaccaaatttgcgttagtacttatgtgtggaattttctatttgtggcatcgtgttagcactcaaagagttttggattttggagcattttgtattttatattttcagattatggatgcccaacctgtagtaatattcctgctttcctaactaaattaaaattttaattagatgctaaaacatattcctctaagtagctgtcaaaatacactatttgaagggaaaaagcagtcacaaaatcataaagtaattaaagagctgaatttgggtaaggaaatatggtttgatttagtcataagacttaagacatatgaatcagaaaacaatagttcacaggaaagtaaatgattgaacaatttagagcacatgtcaccaatcagctgggtagatataataaatcatagcagtttaaaatatcctaaagataataatgttctctcatgtatccacttttattcactcatatgctcccctgcttgtgctctgaaaagaaccatccttccaagacaatgggtgtgtatgcttgcttcgtagtctaaagtagagtgtaaaagcttgcaggggaatgctgtgctgatccaaaaggagctattttcaaaaaaataaaactgttcatatattttcaagaaagaaattaagtactttttcaaggattgtcaaatacagagaaactggggttggcacataaaacttccaggaaaaagtgaatatttattcaactgaaaaaagtccataattctgaattttaatcttttccactcaaattttacttcagagctcatttttatttttttttctaaactgctagagcaatcagaaagtcataaatattaaagcttgactgtcactctgagaaacattttatggtttttttaagttaaaaaaagtacattaaaatgaaaaacaattctgatattttgtgggagcacctcaactacctcgctacatgctacattattaccatatcatcaaaaatgaagagagactttatatatacttcaaatgcagggccacgtctactcaactgatattttaatcttgcagcctcatcaggaaatggagatgaaggtggagacttgactccaaaggcttattttcttactctacaaagctcaattaattcttcaaaaatgtgcacttttcacattgatgattccaaaagacttccaaaatatttaaacacacacatagacacacaaatgtctgaacagccttaaacagcctactggttggtgtatactatagaaatacatttgtaaaattagttcttcagtaccttctatttacctggcattagaatctggttgcaaaagacaggatatccatatatgaaaccattagaggacagtacaaggcaagtaactgcttaaatgtatcgtaaggacatgtataggtagagggaagaggaggaagtagcgtcatagctgtgaccttcttcagtcctctcaaattaaaggacttgaaagaggaccttcaagaatatgtccactgaattaacgagtttcatataacagtggtttccaaactcaggatgaaccaattcctgactaatatttcacccagcctcagtgaactaagaaaaatgataatcccaaagataaacctgttcaacttaataacatctttttatgcagaaactataaggtttttttcattgaaaaaaaaatagaatgcaagacagtaaatttttgttagtgcccttatttggcaaaaacaaaaatcagcatcactttgtcatttcccacaaaatgtaaaaacctaggacaccataacttacacttcagcttcatctgggaataagcgtattcacttgacattaataagcctagacagttttactgagtcagctcggggcctattgtcagcacactgggacacggttgtggtgtcttgccacaaggaacaagcagcaagtcactgagggaagggatgctcatgtctagagttgcagggagactagaaagacagcagggctgtggtgacaatcatcccttctgcttcacagaagcgtgagcagctcctcagcaaaggtccactgagtgtcgctttgcacagcccaaggaggctgagtggcaaataggtggaagaatctcaaagaagagattcttctcttcattccaacaggtttttatgtgagccaagcactgtgctgaaggagcagctattactggcacctatggggacagtccacaaactcctctgtgaatgtcagtgtgttcaggaacaatcaaagccactggatctgtgacaggtggctgtaacagcagggacatgtcagaagtggagagcagtcaccccacggctaaacataccagctgattatcacacagcagtggtcttcatgggaacaacttggcccatgagagtttccttggagggtcaccacgccagagcgctgccctgcagactgtgagtggggcagtcctggaagtgcacacagccaccctcgccaatacaagacaaggttagaaccaacccttacccctagtctgtaagaaacatcagagaatgcaaatctgtatactgctgtatttcacctctgacatagtatcagtaattttttcattttaaaatttcaccctaatatcaaaattaaaataactagagaagcaagagcaaacaaattcaaaagctagcagagacaagaaataactaaaatcagagcagaactgaaggagatagagataccaaaaaaccttcaaaaaaatcaatgaatccaggagctggttttttgaaaagatcaacaaaataggtagactgctagctgactaataaagaagaaaagagagaagaactaaatagatgcaataaaaaaatgataaaggggatattaccactgatcccacagaaatacaaactaccatcagctaatactataaacacctctacccaaataaactagaaaatctggaagaaatggataaattcctggacacatataccctcccaagtctaaaccaggaagaagtcaaatccctgaatagaccaataacaaggtctgaaattgaggcagtaattaatagcctaccaaccaaaaaagtccaggaccagacggattcacagccaaattctaccagaggtacaaagaggagctaataccattccttctgaaactattccaaaaaatagatagagagggaatcctccgtaactcattttatgaggccagcatcatcctgataccaaaacctggcagagacaccacaaaaaaagaaactttctggccaatatccctaatgaacatcgatgtgaaaatcctcaataaaatactggcaaaccaaatccagcagcacatcataaagcttatccaccatgatcaagttggcttcatacctgggatgcaaggctgctcaacatacgcaaatcaataaacataatccatcacataagcagaaccaacgacaaaaaccacacgattatctcaatatatgcagaaaaggccttcgacaaaattcaacaccccttcattctgaaaactctcaataaactaggtatcgatggaacgtatctcaaaataatgagagctatttatgacaaacctacagcaatatcatactaaatgggcaaacgctggaagcattccctttgaaaaccagcacaagacaaggataccctctctcaccactccaacatagtattggaagctctggccagggcaatcaggcaagagaaagaaatagagtattcaaataggaaaagaggaagtcaaattgtctctgtttgcagatgacatgattgtgtatttagaaaaccccaccgtctcagcccaaaatctccttaagctgataggaaactttagcaaagtctcaggatacaaaatctatgtgcaaaaatcacaagcattcctatacaccaataatagagagccaaattgtgagtgaacgcccattcacaattgttactaagagaataaaatacccaggaatacaacttacagggatgtgaaggacctcttcaaggagaactaactataagaaccatccaagaacatgggagactttaaatttttttctagtttcaggataggagctaaaactgaagtcaaatctcataaaagccaaattgtacaggctgcttcccaggtcctgaaaatgttaacttagagtaaaagggatagaggttaaatggtaaaggagtagagctgggtctatgaaccgaggtctgtctggtcgaggttcatgctcctcaccataatgtttcttctagagtgcttgagataaactggagcagcctgggcatctctggtagggcaccagtttagcagagtaccaagtagaaatgggcaggcagagagttacggagggtgtgcgtaggacctgtggagttagccttggaagaccctggatgcagatcacagtgttgacctttactccttgactgtagggccttgaacaggaagtatcaggataaaaatagcagaggtaaaatagaaaggtcaaccaacaaataattattaaaatggagaaagtctaaagaaagtctaaagaaattaacatttcgaatgcaaggagcatttgtaaaaaaaaaaatcataaaatatttttattgatttgctacactgtgcacggaggtggggctcacatgtgactatgagctttccatctcagcatcccagagaaaatagtatcagtacaaaaacagggaagggaggaagaggaaaggggaagagactgagattggttttagataaggttaagtgacagcctgggatagcctggggcagccagatctggggagatacccacagattttccatccagaattctgagagcacacaaaaacttttgacagattttctttggcaaataaatgtttacttctgaaaaaagaaatgcttactgtgccagtcagtgtgctaggccctggaagtttaagtgatgaacaagttaaacacaaatctcaattcctcttaataaatggccttgacagtaacgtacagtccacaccatgcagcagtaatccacgtattccaatgccagaatatcatgaggatgagaaaagggttaaatgaaaataataaagctcattatggaatgaaatctgtatcttatatagttcactatttggaaattgttttttaatagactgtcatattataattgagattatgatgtaacaaaagagaaatatatgccctatatagcatatagcattattttatatatagccatatatatttgatattaacaaattatgtttaatgacccaataggctaatctacatacaagttacaaatgtttttgactttatgcatttacctagggtttcttagcaaagtgtaacaacctttgacaatttcctatggttattatacttcacaggcacaaagttctaagtctgaggtctgagggagaattgtggttgtgcctctgtaagctgtgaaacgacttctttatatacttcccaagatgcctttcttccttcctgtgccatctccctggtgacatccagctctgctgattccatagatcctctcagactcttgaaaatgatggaggttgggagaggcatagagaaagggaggaggaggaggtggaggaggagggcttcaatgtaaaagccagaccaccccaagtcgattaataaatgcttcttcattgttgaccatggtgtcagctttcccatctgaaatagctgaaataaaagagcacaatgtcaggcaaacgcaactcgcccttgtttatgtcagaaaaagatatcagctgaggaaaagcattaacaaaaccaaaatgactagtttgatatctgaaaataaaatcaccaacaaggttataaagtatggtggtgatgaatgggaaatctatactccctcaaattgacctttctctcccgatgactgtaaatcactgtactctcttaaagctgcccagcatacaagagcttgtggcacgataaccttggacaacaacagcagcaccacttctctctcctgctcttaaaactgcagggttcagatgctctatttgaaaccatcactgagttcaggggcatggtggcctatcatgggttttctcccaaaaagcaggaaatgatagatcttccctcaaaactcagccctcataaatggctaggacttttgtgcagaggcaattctgaaagcaataactttctctaattcttccttacaatataacctaaagggcaataaggctgtctaatacttttgctcaaaactaaagatgattcacatactgcaattatatgtttgcttctctcctgacttggtcacagtttaaaatataatacctcaggacaggcatagtggctcatgcctgtaatcccagtgcctcaggaggctgatgcaggaggatcacttgagaacaggctgggcaacatagcaaggccccagctttaaaaaagtttttttttttaaagttacctgggtgtggtggcatgtgcctatagtcccagctacttgagaggctgagaagagaggattacttgagcccgggaagtcaaggctgcagtgagccatgatcaagccactgccctccagcctgggtgacaatgtgagaccctgtatcaaaaataaaacaaaacaacataaaatataacaccctctacttagaaggagctttttattttaaaaatcaaggcatcttccataaataatgtttcattattctctatgattgatatcctctctaaaagtcaatcataaattaatgtgacaataatgattcaataaatcattaaatactatgagttcattgcatgctataaagataaatgtcatctctaacctcagagaagtctcaggctagataaatcctattaataaatatttatcaagtgcctactatgtgccaggcagaaatgcacacagcatgctacatatcctaagcaaatagcattgggccttgccagttagatcaagccgcccctttgtgatgtaacgtcacctcaccttggggcatcccctgcactggggatgaatttctggtagacaacactggtagagcactcactcacccttcaatcctcctttttaaacactgggcatttcctgcttgtgctaaccatgagaaaaataaggccaagggaaaccattctgtcagccaaggacccacagagaagaaatgagaaaattgtgtgagaaacacaaatttatttgccactcaaccctcatctactgccttaattcctaacccgatggcatcagaatttttaaactatatattttgttagtttaacaaataacgatagaatcccacattacttttaaaaattttaaacaatatggaggtaaagcatagatttttttcatatcaaacatagacactaaaaaagaaagtaaaatagcaaattgctggcaggtacagcctcttgccatttgcaagtatcatgaaaaaaatatgtgaggtaaagacaacgttattttcaaacttggtaatttcccacaaaacctcgcaaaacttttttttttttttttttgagatggagtctcactttacctagaaggtaaagttggccactgatacatgaaataatatttaaaaaacactatggactggttgcagtaaacacatatgaactcaaacctaattccacttcccaactaggaatcatttatttatagaatacagaaagtaattttctttttttttttgaaatggagtcccaccctgtcacccaggctggagtgaagtggcgtgatcttggctcactgcaacctctgcctctggggttcaagtgattctcctgcctcagcctcccaagtagctgggactacaggtgcacgccaccatgcccagctaatttttgtaattttagtagagacgggctttcaccatgttggccaggatggtctcgatctcttgacctcatgatctacctgcctcagcctcccaaagtgctgggattacaggcgcaagccaccacacccggccaacattttattattattattattattatttagagacagggtctcactctattgcccaggctgaagtgctgtggtgcaatctgtgctcactgcaacctggaactcccaagctcaagccatcctccatctcagcctcctaggtagctgggactacaggcacacgccatcatgcctggctaatttttgtatttttggtagagacggggtctcactatgttgctaaggctggtctcaaactccaggaggcctcaagcaatcctccagcctcaacctcccaaagttgtgggattataggcataagccaccatgtacagcctcaaaactattttttaaatttagtttcttccaacttatttactctaaatattttttcctcaaaagctctcacagatgttatattcttcccaacattaaggaattttgcttaatttaaatttttcaaatattccattgtgctttcccaattttcagctcagttatgacttgtgattcaattatctgatgctttccattgtgcaaaagagagcttgtaattgagtcaggtagtccccaagctatggggacaatattaagcatttcttgagctatcacatgaggaccaagattttatgttagcttttgtttatgcctattgggatattttataatgtaaatagaatatctgaatagtgatcccagataattgcataataacaagctatcatgattaatcattactttcactttgtcattcttaatgaaattaaaatgggatttatcttccacttcctatgggatcttttccagtttgttttggttattcactctcctacctggagaccttggcatttcaggcggttattgagcatttacataactttcttttttcaaagcacttgagaaacaaactacatggtgagaccagtttgtggactagagagaattttaattgcatttttatcattatccccattagaactgaccatttccctgtattcacaattccactagagcctcataaaggagaatgctggctccgacaaagaaggtccctgctgctacaaaattaagctgctgaaatttaagcaaactcaaatattttagcatgccataatctcaataaccgaaaatgcaactcttgcaaagacgagtagggctggccatttaataactgtcttccaggaccccaatcccacgtctaagccatgggagcacctggatggtagggactcatttcatggaattaacttcttcccatgagatgtgtgaatgcacagtaccactgtgcttggggcctctgcaatttcattcccattccaatcctccatgtttctgatggtttattagttcatgccaagaattccatttccaactgcaattccagcccaagtgtatctccattttagtgccagttgagatacagaaagtagttctagttgctattttgtaaactgagaaatggtcaaaaacaaaatggcagctttgtggtgtatggatgcttctgggtgttctaattctgaaaacagtttctagaaataaaattttgcagattacttacaacttggacagatataatttgtaatctaagacccctgtcatgggcatttagaaacatggggattttattttctgcctgtttgaaagtctgggaaataaaacaaggtctattaataataattggaataaatgctatagcaccttttagttcaaccacagtttgtttgaatgcttgctgtggatgttcttgtgagggaaccaaactcttgataatctctttgggtgatgattagaaaatgctggttgtgattttttaaaaatatcaaatggattaatgataatcatctagaaataaggtcgtacttcattttatacctaagttgtgatgacatgaggcaccattggcttgattaccaggaagaacaccattcagattgtcccccaaccatctgtagacattcccaaaagcctccatcgcatatgcttgtgcacccacttgtcagaagcatacccatgctgcaccgccccggatttgcttcttttgtttctgctttcgcttgcctctgtttcctgcccatgaagctgtaggtgaaggcacacctccaccaccactcacagaagcatcaaccactagctcacaatgctgagtctggaggaaccaagacttcagtcattaaagtgccagaacttctctgggtcctgagtagactcagtcaagatgactgtctcctacctgtgggccatacatactcacttggacacaaatgacctgtgtttctgtggtctctcttcaacggttccagcttctgattatctccacttttccagggtttcaaaaaatcaatcacgtaaaattattccagcatactctgaccctcacacccagccaaaacaaacaagtacaatcttaagggatacatgaaaattggcaaccatactttcactttagtcctattatccttttttttttttttttacttccaagggtagggcataacaggcattacagctttctccttgttctcttggatgacttgctttgggagaagccagcaccaagtcatgaggatactcaagcagccctgtagaatggcccatgtcgcagaaagcaagccaagtcctcctactcagcactcatagcaagcaccagtttgacagacactgagtgagccaccttggaaaaagatcttccagccccgtcaaaggcttaagattactgctacctcagccaaaatctgactggaactcatgagaaatctgatccggattgtacagcctattttattcccaagttcctgacccacagaaactgtgaaggataaaaaatgttttttattgttttaagccgctcaggtgtgagatagggtgttatttatcaataggtaatgaatacagttgtttctgcttaatagtctttcatcagcaacattcagactaattttatcttcagggacatgattacctcaggtggcacatttgaagctcaaaaattaggcaagcttgtacaccaaaggacactgttcacagaatgaaaatccagctcacagaatgagagaaaaaaatgcaaatcatacatctgataagtgcttaatatccagaatatagaaagaactcctacaacttagcaacaacaaacacacaacctgattgatatatgcaagaatctatttctggaagagaagagagagcccagaaatggattcttcaaatggtcagttgatttacataaaggtataaaggtatacattggagaaaacattattttttcaacaattgatgctagaacaattagatgttcatatccagagaagtaaataaacatcaatctgtatcttgcaccacatacaaaaattaatacaaaatcaatcatagactttaaatgtaaaggatacaattataacatttctagaatacaaaaacaaagaagaaaaattttttgagattaagcaaaaatttcttaggtatgacaccatagaaaaaaattgacaaattgaacttcattgaaattaaaaccacctatttttcaaaggcactgttaagagaataaaaagacaaggactgaaaagagatatttgcaaatcacatttctggccaaaggtttgtatccataatacataaagaattctcaaattttaataataagtaaaacggcccaatttttaaaatgggtaaatgatttgaaagacattttaccaaagaagatactcaggtggcaaataaggacatgaaaaaatgattaacatcattagtcattaggaaaatataaattaaaaccacaatgagatgctactgcatgcttttataatggccaaaattaaaaagactgaccacaccacatgttggagtaactggaaatctcatacaatgctaatgggaatgtaaaatggtacaaccactttggaaaacaattcagatttttttaaaagttagacacatacctagagtacaacctagccattccacttcaagatttttatccaggagaaatgaaggcaaatgtccataaaagacttgtacaagactgttcatacagctttatttgtaatagccccaaactggaaacaacccaagtgttcatcaacaggtaaatggagaaacaaattgtagttttttcatgtgatagaatacaataagaatgggctgggcacggtggctcatgcctataatcccagcactttgggaggctgagacaggaggatcacctgaggtcaggagttcaagaccagcctgaccaacatggtgaaaccccgtctctactaaaaaaaatacgaaagtagccaggcatggtggcatgcgcctgtaatcccagctacttgggaggctgaggcaggagaatcacttgatcccaggaggtggaggttgcagtgagccaagatcacaccattgcactccagcctgggcaaaaagagcaaaattccatctcaaaaaaaaaaaaaagaaaaaaaaagaatactataagaatgaatacatgcagctgcagctacatggataaagatcaaaatacttatactaagtgaaagaagccagacaaaaagagcacatactgtatgattctatttatataaaattctaaaaaatacaaattaaactatagtgaaaaaaagtacatcagtggttgtctggggacatagaaatgccacagaaaggagatcgggaaagggatttcaaagaggcataaagaaacctttgcaggtgatggacatgttccttatcttgatagtgttgatgattccactaatatagtatatacatatgtcaacatataccaaactattcactttaaatatgagcagtttcttgtatatcaactattcctcgataaagctgatttttaaattaggcttaccagcattttttaagacacattgttagctcatttggggtttttgtttgtttgtttgtcttatatctaaaggctacattaaatgccatcataaacaccaccatagatatccaaaatatttgggcaaaaatacaatagagatataaaatcaaagagaaagctaacccttgttcatgacagcccaaagaagataaccacctacaaacagctcacacagccttggggaagaaggaaaaggaaattgcctgtcagagaagctctgtttgtaggactagattagcctcctctccttatgctgaaagtttcccactgacttcaaagaagtgctcagatcagagaaaagtagagctaggctgaataattgtagtgaggttggggctgccttaaagacaatctcttttgagctgtacccatgatgacattatcatattatcaatgataaaagggctgtggggtgggactactgagccacaaaagcactcttaagcatcaaagaggagacaagaaatacattcaaataaaagcagaaatttaaaatcatgggatatggatacacctccttgctgtaggagtgactgtgacaaattagaaactgtttctgtttgggactggctttactagttatcactagttttggggaaaaagcgtgtgtgtgtgtgtgtgtgtgtgtgtgaagaaagaggattcactataacacaatccaccataatacaatagcttaatattgacacaagcacaatttgagaagcgggatcttgccaggacacatgtaataatcacaccttgcacaaagaaatagaaacactctactgaggtaagatggcccaaataatacaaatacagttgactcccaaataatacactgagaaactgaacagggattgaatagtctagcagtaagatctaaaatgttgctggtaaaaataataataattagtggatagatttatgcagtttcacaagccagcaggaaaaattgaactatctattttcctcatgctgtacaccaacagtgatcagtcaagctggaaatctgttcttataaactgagctagaaatgtcatttaatgttcctggtaaaatatcaattcaaagacctgacgtgtattagaattaaggaaagatttagtgttggatagcacaaagaaaacaagactagaattctaaagacctctaatgaaaggctgaatgtgttgataaatatttgagcaacacagaaaagagagattaatgccagtttgggttgaatagaggaacatttgtgacacacaaagaaccacagacaggtgacataaaaatagagaatactgttaacatcttgtacacagaagatgctccaaacaacagtttctatgtggagaattatcctgttcagcaatccattttggttatggaaaagcagccaacatggtttgcccaggataagcaaggacaaacaatgagaaagatgaattgccgggcacgaaaagggagaagaaattttaacattctggtacagccccacaaaagagacgtaagagagagatttttgagttgagcagaaccatggcaggaagctaaaagacagaaggaggaaattttagccagggagaaattccctttagcagccaagggaaaagaatccaaggggtcaaatacttcatcttacattatcatctatgctgttttgttatctaagtctctgctactgcctgaaaatcttcagtaaaagttatgcccagttgatgcaccgagagacatttgagagatgagggaaaatacctgtgcaccccaccccattcaagtctctgcaggacagaaggtagacagcaagctgggggcaagatgccaggaggagagagggatcacaaacagaaaactgaagtgaaggatgaatgtgtgaacacccctgggaatccacagaaatcttcaggaggacagggacatgcaatttgaggttaaagtatttttatttaaacctcaaaaaaacaagaactccagctaacacctggctctgtatataaggcaacctctagagatgcaacatctgatagttcaagagtaaatgattacatgtatagatctcccggcattcatgcttgactctttctttccccttgataaattttttttttttttggacatcttagcaggtccaccaatgtccattcaatctcagagaaagataggactactcagattgatttattttctcttttaccatctctggcacaagctgttattggaatgtttccatttcatgattctgcacatgtttacacagccgtaagtgttcaagtgagaaacattgctttgctcctattccactatctctgtgtatgtgaatgtgtggtatgcgtgctcctatataaataccctgacgaactccaatgagtatatgattttcctatttcctggagtgggtcaatttattgtacagtctataaaagaccaatgaaactctctttttgcaactgtttgcaatatttctcagctgtggtaccaatgttttccccaaaactaagtactgatttatgattccagtgacaaactaacacaatgttttattatttccagaatactgacctcagaaagattttatttggccagccacctggttagttgaggagtgagggctattccttgaatataataattgacactttagaaagtttctcctgatagtaaattctggagaacaggcatctataatccaaaatgtctaatgagccaatggggacattagagaatggtcaggatgttttacttatgtttaaatgtttatgtaacacttatagctagagggaaacttgttattgccatctttgcaattattatgttgtttctgttttaccatctcttgtaaaactacagaaaaggaatcgatgatttcacatgatccttggaatatgtccatgatccaactgcttgctttggagtggtttttttgaggggggcttttttggtttgatttttctttttgctgttgttgttgctgttttgtttttctttgagacagagttttgctttttttgcccgggctggagtgcagtggtgtgatctcggctcactgcaacctccacctctcgggttcaagtgattctcctgcctcagcctcccaagtagctgggattacaggcacctgccaccagcctcgctaattttttttttttttttgtatttttacataaaaatagagatggggtttcaccatgttggccaggcctggtctcaaacacctgatcttaggtgatccacctgcctcagcctcccaaagtgctgggattacagcatgagccacggcacctggccattttggagtgtttgagaaatcaacacacctagtgtgtttcaacttgaaaaggacacgatgatgcagagctacctggttagttccctagttaactatactaaagcctacttgacccttggtgacagctttccaacatgctgacttctgcctcttttacttattgatattgcctattctggttagcatttatcatgatcctctgagccttttcccattgactgcaccggaattagttagttcctctatgagttttgcaataattgccatatctatttcaaaaatccaaagcaacaatttaccatttagcaacagcacttgttttcaattgttcccatttcagtgcttttatcaatagatacatacgcacactatgaatttgttcacattcatttcatcatatggtctttcattaattcaatgattagcatgtccagatgagcacacacgtttctggaaccacacaagatgctaggtcttttaaggcaaaaatagatctatccctaacttcatggcacttatggtctgaaagtgcttacttatccaagtcaaaacagagtcctgagggacagatcttttctgcaagctactagaattttaaaggtatattttttcttaagaaaatcactttctcattattactaggtcatttgcttctgctttttgctattccccaactgtattcattttcacttatcacagaggtgtaaattgatgaaaattaagtatttccactttatttaatattgcagtttaggggaaaagatggtaactacagcctaaaatcaattttgaatataaagttttaatattatcaactagtttttttttattctaatcctcattaaaaaatttggcctagcggggtgcgctggctcacagctgtaatcccagcactttgggaggccaacgcgggtggatcatgaggtcaggaaatcaagaccctcctggctaacacagtgaaaccccatctctactaaaaatacaaaaaattagccaggcatggtagcacgtgcctgtagtcccagctacgtgggaggctgaggcaggagaatcgcttgaagctgggaggcagaggttgcagtcagccaagattgcaccactgcactccagcctgggcaacacagtgagactctgtctcaaaaaaaaaaaagaaaaaaagaaagaaaagaaaaagaaaaaagaaagaaagaaaagaaaagaaaatgtggcctgaggacaagtaaaatagaatgcatttcatacagaatgtttgtcaaaatgaaatgaaaatagtaagatgatattacagactcacactgagtttttatgtatgtagtacagtgccatcccacagcaggactctcaagacatcatctgtttcctttctggtccccaaatgaatcaggcaattccgaattggtggcaagggctagaatattacaaaaccatgttgactctgatcatctgtctgttaaggtaaactggagtccaaggagtagaaagcgttatgggccaggcaatgctgacgggatggtagggtgcacagcaatggcaagtaataatctctcagggaacaattctcacagtctcaaggtcattagcctatcttcctatctatgcacccaggcaccttagaaagaaaggaacacagagggaactgagaaatcagagctttctttgtggctctgtctcttttctgcatcttactgggttaacagagcccttcttggtgcccaccgtccaccaaaagcacccaaggagtgcacagagaatgaagagcagggacaaggtcagacaggagagacctgctgggagacactgaacacacggagtggatggagcggagtaagaaaatgtacagtctcattaggaatgaggtaccaatgatggtgtctccaaatccagcagacctctgggcatagttccaggcctgaattaggattttgtagtcattttcaagataaagcacttttcctaaatatcactagcttttactttagtcacctatgtctggttctcattaaagttcctgaccattgcagtcattttatcttctaagtgcaagtgagaaacaggagtgggtcaatgctcgcaccaactgggcacttgaaagaagaatttgaacaggacacaagaagtagagactaagggacaccagcctatgaaaatgtactgcagcacatttaagctggaggcatcaaaactggtatcttctacacaaatgcagctgttctctctactgtttagcaccatagagcctgaaggcacatcagagagcatctcatctcagctaatgcctttcctaaaggccacagaagagttccattaatgtgtggccagcccaacacccaggctctccaatttccaatcctgcaccctttttgcagctaataatagctctactatttgtggtacctattatgtgccagagacttattctaagtgctttacgggtgttgccttacttaatcctacagccacccccgtgatgcaggtatgtgctactgttgccattttcaggtgaggaatctgatatccagcatggatgagtaacttgctcaattccaaagctgacaaaagggctgagcttcctacactgaatccatacactctcctacacctaagatccatgcttattccccaccaccaaccttctgcttccttcaccccagggacacatctgtggaaaagactggctacttggtgcttcctttagccccacttcatcatgcagtaaagtactaatttctgattgatatctgtgttgcacacatagaacatcagaacacacagttttaaatgtacaaatgctcggtgatctctctaaagttgggggaaaagaataatagcttgtttgtcctcattctttccaagattcttgtttctggaaatgctttaagcaatttaatgcctgagaggaatgtcattctctccagtttcaacacctttagtttaatgtaaaaaataaaaaatgtataatcatgaaataacagagggaatgagaaagctgatgtaatagtgagctgaatctttactggctctgataaattaactaccaaattggcaattgaaccccatgccagaagtagaaatgtgtgtgaagccacaggctaattatatcataccccttgctgttactaaaactctcattgttcataaaccaccaaccagggctgcctgaggttgccgctatcttttccttttcttttttcaatttctggtgcaacaaaaaacaccttttgaatgaataaaccaataaatgacatttttgttttcctgctgcacagaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggaggtgaggaaaggttgcctgaaacctgcgcctacctatgagactgtgtgcctcccccatagcctcaggtggtgggagggactgctaaaaccttcacttttaccctgcagccaagtagcattcatttaaatcatctcaaatacatgaatgttcaacctctttttagcaattactagatttagcttcagagttgatagcctaacccagaattagtgaccactgttgattccccagatgatttttgtttgtttgtttttgtttttgtttttgttttttttgagatggagtctcgctctgtcttccaggctggaatgcaatggcgtgatcttggctcactgcaacctccacttcccaggttcaaacgattctcctaccccagcctcctgagtagctggaattataggtgcacaccacgacactcagctaatttttgtatttttagtagagacggggttttgccattttggccaggctagtctcaaactcctgacctcaggtgatcctcctgccttggcctcccaaagttttgggattacaggcatgagccactatgcctggccataaatttttaaaatacacctagaaaatatttttatttgagattagggaaatcaccatcggcgtttgtagagaattgatatatctgtcatacaagtgcgtaaatatgggcacctgatatacgtgataaaaaccctctgtcctggtgcacagccttgctgctattggtatatgcaagtacaaggcaatgaggggcctggctattttcccctccaggctatgctatgcagagtcatgaagaaatgcatttccataatatacagaactgtgacacaggcagccacattgattctttaaataagcaccaacctttccacctctgaacacttctattcagtggaaatagaatggaaaaagctaaatagccccaggtcccaaatttaaaatatctatcttttggcatagaaaagactattgcactgggttcggttccattcaatactgttgctatagcctttctccgtagaatagagtgtgctaaagcaggactaaaattggatagggtggatttatcctagcaattcaacctgctcttaacagaggatatcgggggaaatgcatgaaggctagatgttcacaccgtcccacttctccagcctttcagaaatcaagagttgattgtctcgcattgtggaagagtatcatcagtgtccttggttttctagtctctgaaagaagatgccattgcctagatagtgtctgtggctgcagagctctgagaaaaggctaccccagggcatggtaggagaggccagaggactcaggcagtgttcctgggtgagctgttccagatccctgtagaagacgtgttcagcaagtcacaggtgcactgcttgttgtgttcagagggtcactcttcatacctgggacacccaggatgaaggaaagagtcaatcctgccactacaccctccatctcctcatggtttttgcatgtgtatgtcatcctgacattgtctgcttaattcaagttattaatttggtctcatcctttgcatcttaaacattttattaaaacatccctagaatattagtaatattagcctgcttgtattaatttaactgtctaccacagactcaattcacagcagtggaaatttgaaaagaattttcttaatcctaacgtgttggaaggcatgggaagtgagttccttctacagttttttttgtttgtttgttttttatgtataaggttctgtttgtcatctttctatgatgattcaaatgctgtcctgcctagtgactaagaaatacacttgaagagcccacagtatcattgtgtgattcactacagggctaaaatctcatcaatcttttatctgccttatgtggatatgtgaatttttcttcctaccagttactatgttctgcaaactgcaactggtcacatttttcccacagtacctgattaaaccataacctgaatttataagcaccttttctaaatagactcaaatcttccactcagtttctaggaaaggtacaaccttccaggaataatcaaaatcagaaccatcttaagcccaagtaggcgatgccagtgtgtttatatctattaccctagattgcctcatacttttacaacacttgccttatccctggagacatttgcattcattatttccggcttaaacaatgagacgttgagaagatcagattttttatttttcccgagacaaggatttgctctgtcacacaggctggagtgcagtggcatgatcatggctcactgcagcctcaaactcttggactcaagtgatcctcccacctcagccttctgagtagcccagactacacattcacaccaccagtcccagctaattttttaaattttttgtagagactaggtctcaatatgttgcccatgctgatcttgaactcctggcctcaattattcatctcacctcagcctccccaagtgctggaatcgcaagcatgagccaccacacccggcaacagatttttttttcttttttaacacaaatggcaaatttctttccccaaagcctcagaacagtaaacaaataaaggtcatatttaggtttaggaaagaagaaaatggggacatagtttatgggccagttgcattcagttgaatttgttcggtgaagatgtgatgcatagcaagaatgaagacatagaggatgggaggaaggcaagaagaaaggaaatcaataaaagacaagggtttgcactgttaaatactagtttttaaaagtatctaattctcagggagaatagatctctgagagtataagtgaaacatgtacatttaatgcaggaggcaagtgaaggatttgaaatgcagcttaatcaaaatgaaataatgaaaaaagattattttctaactctaggtgggtaataatatttttaagagtggctaggctgggcacggtggttcacgcctgtaatcccagcactttgggaggcagaggtgggtggatcacctgaggtcaggagttcgagaccagcctagccaacatggtgaaaccctatctctactaaaaatacaaaaattagctgggcatggtggcatgtgcctgtaatcccagctactcgggaggctgaggtaggagaatcgcttgaacccgggaggtgccactgcactccagcctgggtgacagagtgagactgtctcaaaataaaaagaaaaaaaaaaggataaaaaattattaaaagtgcagaatatatgtgttgagcaacttaatctctgacaaaaaaaaagactttcaaaatgttgacacatgcgatttcttttgcctttcagaggatttcttaaaataagctttttattttggaataattttaaatttacattcttctaatgttaacattttatatttactttcactcgcgtccctgtgaagacaccaccaaacaggctttgtgtgagcaacaaggctgtttctttcacctgagtgcaagtgggctgagtccgaaaagaagggagataggggtggggccgttttataggatttgggtaggtaaaggaaaattacagtcaaagggggggttgttctctggctggcacgggtgggggtcacaaggtgctcagtgggggatcttctgagccaggatgagccaggaaaatgaatttcacaaggtaatgtcatcagttaaggcaggaacaggccattttcacttcttttgtggtggaatgtcatcaagttaaggcaggaaccagccatctggatgtgtacgtgcaggtcacagggaatatgatggcttagctttggctcagaggcctgacattcccatcttcttatattaataagaaaaataaaacaaaatagtgttgaagtggtggggcggcaaaatttttggggggtggtatggagagataatgcgcgatgtttctcagggctgcttcgagcaggattaggagtggcgtgggaacctagagggtgagagattaagctgaaggaagattttgtggtaaggggtgatattgtggggttgttagaagaaacatttgtcatatagaattattggtgatggcctggatatggttttgtatgaactgaaaaactaaatggaataagacaaggagaaaaacaggtattaaaggactaagaattgggaagacctaggacatctaattagagagtgcctaaggagattcagcatagccctgccagcaaagattatttatttactttaagagggagtcaagagtggcggtttggggatagcaccaggagatatcagctgtgatggcttggagaagcagtgaaaaccggcagtttttctgagaacagtgaataggagtatgactagacagaagacagtagggatgacaagttttttggggcacagtccaagttggtctggtgtctggaatgaggctggggcctaataaaaagaagcgtctatacaggagctcaaatgggctgtaccttgtagcattctgaggacaggcctgaattatgagaagggaaagaggtaaaagtattgtccagtcctttttaagttggaggctgagcttggtgaggtgtgtctttaaaagaccatttgtccattctacctttcctgaagattgaggacagtaagggatatgaagtttccactgaataccaagagcctgagaaactgcttgggtgatttgactagtaaaggccgatctgttataggactgtatagaggtgggaaggccaaaccgaggaattacgtctgacagaagagaagagatgaccgtggtggccttcttagaccctgtgggaaaggcctctacctatccagtgaaagtgtctacctagaccaagaggtattttatagtttcctgactcagggcatgttgagtaaagccaatttgccagtcctgggcgggagcaaatccccgagcttgatgtgtagggaagggagggggcctgaataatccctgaggagtagtagaatagcggatggaacactgagaagtgatttccttgaggatagatttccatgatgaaaaggaaataagaggttctaagaaatgggctagtggcttgtaacctacatggaagaggttatgaaatgatgacagaatagaatgggcctgtgtggctggaaggagatattttcctcggtctaagaaccatttgtcttgtgtgggaagagactgataggtggaagtttcagcagggcagcggggcagtaggtgggagtggtcagatgagaaggagaaaaactgaaagtgaggaatagaagttgcaacgctagctgcttttttagctatcttatcagcataagcattgtcctgagcgataggatctgatgccttctgatggcctttgcagtgaatgactctagcttcctttggaagtaaagcggctttgagaagcgtttttattaaagaggcattaatgatagaggacacttgtgtagtgagaaaacctcttgcatggtggtgcaggatatggaaggcatatttagagtcagtataaatattgacgtgtagtccttttgcaagagtgagggcttgatttaaggcaatgagttcggcttgctgagaggtagtggaggggggcagagcagtagcctcaatgatagatgtggaagataatatagcatagcctgcctttgctggtgagtggtgattaggcctggtggaactgccatcaataaaccaagtctgttcagggtgaggaacatgaaagaatatggggaaatggagtgaatgtcaggtggattagagagatacagtcatgggggtcaggtgtggtatcaggaataatgtaggaggccggattgaagtccgggccagaaacaatggtaactgtgggagactcaacaaagagtgagtacagctgaaggagccagggagcagaaagtgtatgtgtcaggtgtgaggaagaaaatagattttggaagttatgagaactgtagagaatgagttgagcatagtttgtgattctaagggcctctaaaagtattagggcagcatcagccgctgcacgcagacttgagggctaggcaaaacagtaaggtcaagttgtttggataaaaagcctacagggtgcggtcctggtccttgtgtaagaattccgactgcacagccctgcactttggctgtgggtaatggaaagggttgggatgagtcagggagagctagggtgggggtagtctctaaagctgtcttcaaggaacagaaagaggagtggggaaaggatttaggatctgtggggtcagctaggtttccttttgtgagtttatataatggttttgttaggatggcaaaaccaggtatctaaagtcgaaagtatccaaccatgcctaagaaggaaaggagttgttgttttgtagaaggtgttggggtttgagagatcagtcagacatgatcggcagggagcgcacgtgtgtttttatgagaattatgtcgagataggtaacagatgaggaagaaatttgggcttgactgaagtaatgggggctgtctgtgaagccttgaggcagtacagcccaggtaatttgctgagcctgatggatgtcagggtcagtctaagtgaaagcgaagagaggctggggtgaagggtacaaagcaatagtaaagaaagcatgtttgagatccagaatagaataatgggtttgtggagggaggtatttaggataggagagcatatggggttggcaccatggggtggataggcaaaacaatttggttgataaggcacagatcctgaactaacctgtaaggcttgtctggtttttggacaggtaaaatcggggaattgtatggagagtttataggctttaaaaggccatgctgtagcaggcgagtgataacaggctttaatccttttaaagtgcgctgcgggatgggatattggcattgagtggggtaagggtgattaggttttaatgagatggtaaggggtgcatgatcggtcactgaggagggagtagaggtgtcctatacttgtggtttaaggtggggagatacaaggagaggatgtgaaggaggctttgaactgggggaaaaggtggcaatgaggtgtggctatagcccaggaatagtcagggaagcagataacttaattaaaatgtctggacctaataagggagctgggcaggtggggataactaaaatgagtgcttaaaagagcattgtctaagttggcaccagagttggggagttttaagaggtttagaagcctggccgtcaatacctacaacagttatggaggcaagggaaacaggcccttgaaaagaagctaatgtggagtgagtagactccatgttgattaagaaggggatagacttaccctccactgtgagagttacctgaagatcggcatccttgatggtctagggggcttctgaggcaatcaggcagcgtcagtcttcagccgctaagctgagaagatctgggaaggagtcagtcagagagccttgggccagagttccaggggctctgggagtggctgccaggtgagttgaacagtccgattttcagtggggtcctgcacagatgggacatggcttaggaggaatcctgggctgcgggcattccttggcccagtggccagatatccagcacttgtagcaagctcctggaggaggtgggcctggaggaatgcctgcctgctgcggtttaggcgtttggaagttcttgtgtgctggagatgtggctggggtttgtctcacagtggagggaaggaattgcaactcagaaatacattgctacttggctgcctctactctattattgtacaccttaaaggtgaggttaattaagtcctgttgtggggtttgagggccagaatttaatttttggagttttatttaatgtcaggagcagattaggtaataaaataaaatgcatattaagaataagacggccttctgacctttcagggtctagggctgtaaagcgtctcagggttgctgccaaacaagccaaaaactgggctgggtttttatattcgacgaaaaagagcctaaacgctaactgattttgggaggggtcagataaagaaaaaggagcattaaccttgactatgcctttagctccagccacctgtttaagaggaaattgctgggcaggttggggagggctagtcacggaacgaaactgtaagccagaccgggtgtgaggaggggaggtgataaaaggattatagggttggggagcagaggctaaggaagaattgggacctggctcagcctggcgaggagcagcctggggaggaggggagaggtcagatgggtctgtagaaaaggaagattagaaagactcagcgacgcttggggttgggattgaggggacaggcaggagggaaagaaggaagatttgggataagtcgcattgggaacagagactagggagggaacaatgtgtaaaagaatgcctggacaccaggcacctcagaccatttgcccattttacgacaagaattatctagatcttgtaggatggaaaaatcaaaagtgccattttctggctatttggaatgactgtcgagtttgtattggggtcaagtggcattgtagaagaaaataaggcatttaggttttaggtcaggtatgagttgaagaggttttacgttcttgagaacacaggctaaggaagaaggaggaatggagggtggaaggctgcccatagtgaaggaggcaagcccagagaaaagagagagtagagacttggagagaaagggtgggggtgcttgccctccaggaaagtggagaaggggtagagacacggggagaaggggttggggggttcttgcccaccagaaaagcggagaaggggtagagacacagagagaaggggtgtggggtgcttgccctccaggaaagtggagaaggggtagagacatggggagaaggggttggggggttcttgcccaccagaaaagcggagaaggggtagagacacagagagaaggggtggggggtgcttgccctccaggaaagtggagaaggggtagagacacggggagaaggggttggggggttcttgcccaccagaaaagcggagaaggggtagagacacagagagaaggggtggggggtgcttgcccccccaggaaagtggagaaggggtagagagagagaaggggtcggggggttcttgcctcccagaaaagcagagaaggtgtagagacatggagataaggggttgggggttcttgcccccccagaaaagcggtacttgctgctaagggtgaaggaccaaggcaggcgtccccacgtggtcagacgcctctgaaatgtgggtgaataatcaggcaggcatccccacgtgattacacactaagggaagactgtcttcccaagtccgtgaccggcaccagagttttgggttcacgggtaaaacgtgtctcctttgtctctatcagaaaaggaaagaaattgaaattaagagaagggagagattgaaagatggtgccaagattgaaaggagaaagaggttgagggatagtgagagaggctggagaagagaataaagagaggctgcttaccagattttaaattggtgagatgttccttgggctggttggtctgaggaccagaggttgtaggtggatctttctcatggaacaaagagcaggaagacaggggattgatctcccaagggaggtcccccgatctgagtcatggcaccaaatttcacgcatgtctgtgtgaagagaccaccaaacaagctttgtgtgagcaacaaggctgtttatttcaccagggtgcaggtgggctgagtccgaaaagagagtcagcaaagggagatggggtggtgccattttataggatttgggtaggtaaaggaaaattacagtcaaaggggagggttgttctctggctggcaagggtgggggtcacaaggtgctcagtgggggagcttttgagccaggatgagccaggaaaatgaatttcaccaggtaatgtcatcagttaaggcaggaacaggccattttcacttcttttgtggtggaatgtcatcagttaaggcaggaactggccatctggatgtgtacgtgcaggtcacaggggatatgatggcttagctttggctcagaggcctgacatttaccacattaactgtggtatatttaatcaagctaagtaattaacattagtataatactattaactaaacaagactttattcagatttcactagttttttttgctaacgtcctttttctgttccaggatccaatccagtatctgaaagagctttttagtttcctataaactttaaattaattgtcagaatgggcggagttcctaaataaatgtaataagtcaattattattttagtaagaaagtgaaaaggagaatgcagactcggtggttctttttaagcatttatgggaaggaaccacaaacctccagcaatgtaaacacaagattcctttatgggagatctgggccaagaagcagggcaactcaccattttatgcacttgtacttggaacagttttccacctgcttgtctgcgccagcctgattctgggtaaacaatgacgtgcttaggcaatttttggctctggtacttggaactcagcttgtaaaggatatgttacagaccataaacagcctataaaccgccactcatttccctgacaaattcagctggattactgcacttgtctcctggctcatctccctgcttctgcctgccgcgcttcggtttattctcaacacagtccacttaaaacaaactggagacgaggccaccactcctccattcaagctttcactggctgccatctatttctaggtaaaaatgaaagtccttacctataagattctaaacaatctgacccctgttgtgtcccctccaacctcctctctgactcctcaccccctggcttcctcctctcagggcccactgtcctcgtcaccagtcttcacacaggccaggtcagtctgacctcagcacctttgcatttactattcctgcagcttagaatcctccagtctcagaaatcatatggctcccgcccttacttccttctggtcctcactcaaaaattcatcttctcagtaaggtcttccctagtcatcctatctaaaattgcaacaacacccacacacatccacatgcatacttaaacactccctactccctttcctcctttatttttctccctagcatccatcactatataacaagccatgtaatttatttttttatcatgtttctcatctatctctcccactagaaagtaaactcggtgacacaaggattttgttggtttgttgtgttgctactgctctttcgcagaaagacatagtgtctagcatatagtaggtgcttcataaatatttgttgaatgaatgaaagatgaatgaatgggggatcctggctccctgttgtcccacctgccattcacagctttgcccacacacctgtgtgtgtgaagccaccccagggcacactagacagtcactccctccatggccacacaaagtccacttctttggaaagctcggccagaaaggcagtttgagtaatgactctcaggtaactgattctcatgaacagtcgggtctgtggtccatttgatagttaaacaagttacaaaatattccgttctgacatcctatggggaagaaggagaaactccaaaagttaaaagcctctgttcagcaatttccaaactctgcctaccagcttcctacttaaaaggcagaagagattacagtcatatctgatatagcagtactctccagaagtcattccatcctctggtaggcaaggagagtgggtagagtggggaggtgatgagtcccagagagaataaataggattctgaaccatggaataaattgaacagccctcagtgctgttcaaatagaagcaatgtgctttcccccatgctatgttggatagggtaagaacaggtttaaagtggaaaactattcttaaaccactcacatatggagtgcctctttttgtgtcaagatgctaaatgaaagaaactgaattccctattattttcgccttctcctccttagaattcatgaatttgctaaagtcatttagagtgctcctttatagtctaaaaagaagagttctgcagaattctaaatatcatgtgtaagaaggaataaaagatgtaaaatagacaaacgtgtcttttccaaccagtgccataaattcttttaagaagtgtctgcttactgtcctcaatgtgccaatctgggtacatccatttgtcaccttgcgattgtgcaaactttttaaaaaatctttattttaaaaattcatgtcaataccgaactacctaggctgtttatttgaattccttcctcaagattaatgtcaccccgaattgtggaacattcacaaagacaggcaccctaaataattccagttctcctcttctgctgcaggctgctgttcttaacttcttttcacctgcttgcttctttcttctaatgttctggcagtgcacaaggcttttcaggtttctccctatcagcttacacgaaaggaagttcaacactaggagatgcattatctcaaagaccatctgaggatgcgatgttgtctctttcaaagaaattctgtgtgagtgctgctgatgtgtgatgcaggagtaaaaagcaggtgctttctgcacaacgagcgaggctccctcacattcttttgggagagccaaagccaactttcctgaattcccctgcaatctagtctcacaaccaggaaagctgcaaagtgagattgtcctgctatttccctggcaactacgcggcaaactgcctctgccctttaagtgctatatctcatcaacccagatctttaaattaagcactcattcagagatgatttatcattcagactgtattagacttgacttgatctgtcatttattttctcaggcagaggcagtgctggtacactatgctaagtcatctctctggggctcaaaaacgaggttgggaaaaatgtaagaacacataaagaactgcattaccctctcaaatatttctgtgctttctgagttttcaacattgagacagggctatgaagacaaacctaaagtgtcctataataaacacaatttgtccaggcgcagtggctcatgcctgtaatcccagcactttgggaggctgaggcaggaggatcacaaggtcaggagattgagaccaccctgtgaatggtgaaaccccgtctctactaaaaatacaaaaaattagctgggcgtggtggcaggcgcctgtagtcccagctactcgggaggctgaggtgggagaatggcgtgaacccaggaggcagagcttgcagtgagctgagattgcgccactgcatccagcctgggtgacagagtgagactctgtctcaaaaaaataaataaaataaaaattaaaagtaaaaattaaaaaaaaaaaaacaattttaattccacattcccagacgagcaaattggacatcttagtgccccaacagtggcaatttaattcaagtcataacagaattagaggtgcttccgagttaaccaatattttttttcttctcctgtatggcatatataaatttggcaaacaaaacattctgtcttatctttctgtttattttataaacatatgtatttgtatttgatatatgttaacacacataaatatatacttttttggatttgtgtgacaggagtccatgacattttaagtgtatgttagcctactcatcaattcatcttagtatttaattttcagtgaaaattagtgcctttctaattccaagaatgacactaaattaatagaatttaaatagaatgaataaaattaatctttgccaaaataaatcagttgggagaatgttagactgaaaaattaagagaattgaatagaattcactgaactatcatagcaaaatttctaatccacagccttagaaagttagcatatgtacaaaaattcaatataatttttccggtctcggacataggaatacctccaccctaccaatggggtgacatagtgacctgctggcttctgtgataactaagagtggcctctacagtggcaactgccctcaacttgccttaaacatccagtaaccatccacaagctggtggacaagaatagcgcagccaattaaaaaggagcaacggaggttcctggggtcctgggatgaaattttttaaaacagggagtcgatctttttttttttttgagatggagttttgctctgtcacgcaggctggagtgcagtcgcatgatctcggcttactgcaacctctgcctcccgagttcaagcgactctcctgcctcagcttcccaagtagctgggattacaggcatgcgccaccacgcccagctaattttggtatttttagtagagacggagtttctccatgttggccagactgatcttgaactgccctcaggtgatccacccgcctcggcctcccaaagtgctgggattacaggcgtgagccaccgcgcccagcccagggagtcaattctaagactaatgccagtatgcattattgggcttgaaatttgattttaatcatctgcaggcaggcaacagttaaagatgagagccaatattcctctaagtgtccttgaaatgtagtgagccgctgtgttagcagcaggccaccgtgggcactgccccaagctctgagaagtgtggtgactgtgccgctaaaaggtaagttgtctcttacattcacaggagagacctttttagcaacctcaaggtcatcggtcagtcttagattttgtaagcaacccaaaacatagctacctctgtcgtggtttgggaggtgtgctccccatcggcctccgtggctaaattctttctccgtgtttcattttctcacaattatctccgtgtctttgatccacttgattgcatttcctcctattgactttaggagatgcaggaattaacgtttaccttatatttccaaagttctctgtttgtgtaattgataacctagttgtattttgctcagccttcacttacattttcccttagaccttttcctttttatagagcttgcatggctctttgtgttgagattttattgcccagtcgaaatgatgcctgatcaatttctggaaaggatggcctattgtttaggcccattccaaagagaaactaaaataacaagataatctcaggaggagcttaattttctataccaatctctagcacaggaaggacaaatcagctttttcaagcttgttttagactcaagtcttccagaactaatcatacacattcaaactctttgcctatgcttttttttttgtcagaattgcatacaaatttgtagcaaatacagaagtcttccattatccatggtctcactttctgcacttttgcccaactatattatgaagtcccaactataatattaggggacttcatgatattatattattttggaacagagagagagagagaccacattgacataacttcattataatgtagtgctataattgttgtatattattatagttggtattaatctcttactgtgcctaatttataaagtaaactttaacataggtacgtatgcataagagaaaacattgtatctgtagggtttgatactatctgtggttttaagcatccctgggggtttggaatatatcctccaagaataacgggggactactgtagttttgttttgaatttcaatactcaagtacttccctgttgaaaatgatggaatgatgccagaaatagaaaagctacattttctacaatattctttacttagaatatattagcatttctgatgctaaaagcatggcaacgccatgcttttgtttaatcatcaagaccagacagaacattgaggatagcaaaagaaagaaacaaacaacatggacatgatcttacataaaactgatgacaagaaatccctcaagtactacagaacataggttagtgtcaccaaaacatcagacagcagcagatccagtgtggggccaggagagatgaagaattggtagaaaagaaaaaggggagtactgctacttctccaagaagagtactcagaaatcaacaacaagcattcacgcccaataggagaagagcctttccagaacaggaatgaaagcaatcaaatctgcaccttaccagtggaattaaaagaccctctcacaggctccaagctgaggccaatgcaaagagaccatagggaaccagtaatgtaaaccatgctaacgcagagttaccctgcatatatctgagaaacactccaaagtactaccttctggaaagacagagactcatcctctcccctcctccctctacaaaaaaagaataagaaatctgctgtgaattcaatctaaaatataacactgaggaagccagcaagacaaaagcttccaaaccagagaaggaggtatcagagatagatctcagaaagtacagaatgacaaacacattcaaaggtaacaatactgctttgaaaggaaagacctttagaactctagacaacacagagttagagcaggaagtttttgtgaaccaggcagagccctaagagacagagaagtgcccctataaaaaggccatttttttaatacttcacagtaacaacagagaagagagccctacacaagaatcttcctctaatagtccaagaaaattatctcatttatatatgagattgttcatatatggaaaataaaagcagtttacaataaaaccccatgctgagacaaggataaagataagaattaatcaaatatagttccaacacataaaaatatactacaaaagtggctataaagaagatgaaaactacaacattagatttcaaaatgagctaaaacaatcttaaaactaatcaaagcttgaaagaaccatacaaatcagaattagaactgctcagaaataagatgactagaatgatatgaaacatcattttatggaaagagaactgagaaaactcagggatgaactagaaaagaaagaaacagtatttcagaaatgaagggtatattagaagaaataaaaggacaataagagaccatggaaggcacagtaagagaaactgaggttagaagggagaatgaaactaataaaccagacacaaagaaaagagaacaaaaagaatttgtcaatgatttggaacaataagtgaaggagattcaacataaaattcccaaaagaaggaagccctctgagaagaaaaaacaactaatacataaaactataattcaaagaaaccttttcaaaataaaagatttgaatctatgtattaaaaggaccatctgggaaatccaactaagaaccatcaacactgaaacactttctaataaaatggttgtattgttaaaacaagaaaaaaaatagcatccaagcaaagaatgaatcagactttgaagtatacacattttgtaccagaagacaatgaagcagtagttgtaaagatgctcaagataagaaaatacaagccaaagattttatatccaaccaaactatccctcaagtatgaaggtgggtgctatgatttgaatttgtcccccaaagttcatgtgttggaaacgtaatcgtcaatgcaacaatgttgaacagtaggatgtttgagaggtgattaggtcatgagggcaaagccgtcatgaatgcattgatgctattatcacatatcgggggaaccagcccccaatatttcaatgtagtttatttctattttccctaagtgtcagctggtctgagaaataaagagaaaaaccacaaagagaggaattttacagctgggcagccaggggtgacatcacgtattggtaggtctgtgatgtcccccaagccacaaaaccaacaagtttttattagggatttcaaaaggggagggtgtgtacgaacagggagtaggtcacaaagatcacatgcttcaaagggcaaaaaaggagaacaaagttcacatgcttctaaggccgataaagatcacaaggcaaagggcaaagcaagatcacaaggcaagggcaaaactagaattactgatgagggtctatgttcagctgtgcatgtattgtcttgataaacatcttaaacaacagaaaacagggttcgagagcagagaaccagtctgacctcaaattcaccagggcaggattttttccccaccctaataagcctgagggtactacaggagaccggggtgtatttcagtccttatctcaccacataagacagacaatcccagagtggccatttatagacctccccccaggaatgcaattcttttcctagggtcttaatatttaatattccttgctaggagaagaattcagcgatatctctcctacttacatgtccgtgtataggctctctgcaagaagaaaaatatgactatattctgcccaaccctgcaggcagtcagacctttggttgtcttcccttgttccctgaaaattgctgttattctgttctttttcaaggtgcactgatttcatattgttcaaacacacatactttacaatcaatttgtacaatagtggtcctgaggtgacgtacattctcagcttacaaagataacaggattaagagattaaagtaaagacaggcataagaaattataagagtattatttgggaactaataaatctccatgaagtcgtcacaattaatgttcagagattgcagtaaggacaggtgtaagcaaatataaaagtattaatttggggaactgataaatgtccatgaaatcttcacaatttatgttcagagattgcagtaaagacggggtaagaaattatgaaagtattaatgtggggagctgataaatgtccgtgaaatcttcacaatttatgttcctctgctggggttccagccagtccctctgttcagggtccctgacttcctgcaacaatcacaggagtgggttattgtgggagcaagcttctaataaaagaatgagtttggctcccttccctctttctgtcacccccataggatgatgcagcaagaagggcctcattggatgcagcccctcaatcttggacttcccagtctccagaaccatgagccaaataaatttgtttattaaaaattatagtctgtgatattctgttatagccgcacaaaacagactaagacacaaggccatcaaaaagcagttataaatattcaagaactctgggattatttttaccaaaagcctttctgagcaatctgctggagaaggagcattagaaaaccaagagctgcttgaagaagcttgttgcaggctctggtagaaattggctacaggatggaggaatatacaaattatatataatctgacaatgtagaaataatacaagtaacaagtggggaaagtgagtggaaagcagaatacgtttgctgattgtcgcataggcattaaccaggagtaaaacagtatcatctatgtttagacactggggaggatggaagaaaagcagtaatagttatagccaactttagtattgcttagagaaaggtagagttaggcattaatttaaaaagagaagcttcagctattataaataatattagtgtaaaggcaagaagtggaacaaaaacacaaaccatattaaatactaaagattggaaagagaaaacaggccatatgggaaaagaccttctagataacagtaaattatgtaataaatcagtatgtcagagctgagatcaaacatataaatccacagaaagaaaaagattcagattgactaaaaaggcaactctctctgctgtatatgagacatacctaagtcaaaatgataaagaaacattaaaaattaaagaatatgcataaatatgccaggcaaatttaagtaataagaaagaagggtttgagatcttgataggaagcaaggtagaatacagagagaaaaaaagtcaaaaagttaaaagagactgagaaagacattataatatcaaagactgcaattcattgaaaacaacttacataaggcagaaactgctaaaaatctaaggagaaacagaaagaaacatgctaataatagaaccttaacacacctctcttgatccaagaatgaataagtggaccaaaatgaataaggatgtatagaacctaaaccatgtcatcaataatgtagatctaatatacctatctaactctaaagcatttttggaatttactttcctttcaaatgcacaaatttaaaagtatgttaatgttataaacaaataagatttttgaacacatatcaaaagatatctaagcctaaaattaaagaaacaaataccctacaatcttaaacttgaattagaaatttcaacatcagctactttcggaaaatagccacattctagctttgtccactgaaaaagtctagaaataacttcaatccaatcagtgagcacacctagctctcaattgtggtctctaaatagaattgttcacaaatagaactaaagattcatgaagaaatagctgattctagttgtggggcaggaaaggtagacggtgggctgagatagtttgttactctagaaagtagaaagggaagaaagctttcaaaggctggtggaggtcatgtcaaaaggacatgggagtcagctagaaggggatcccacttgccatagatgagacaacatgaacaataaaaaagtgaccccattaattaaaacaaattgaatatacaaaatgttgtaaatttaaaatgatattttttaaaagggagttaggagagaaagaaaaataaaataaaagtcactgggcaccaatggcagttgcttgggcaccaaatcatgactctagaaattgagatttaaagggaaacaagcatttgtctggcttttctggtataatgtgcatttcaggatgtccaaagagctctgtagttgagggattttatacagatgctcagataataaattcaaaaggaaagaattttctaaatcaacattttgcaattcctgatgcaataactgattaaagaaatggtcctcattagataataaaaccttagatgaagtattgatgataaacttcacaataaaattatcaagctaccatcacctaaacccactgatcaattttagcatcactgaatcatacacattctggtatgatatgatgcaacgtgaaagcattttagacaagccaggaaatcaagaaccatgcctgaaatattctttttataaaaccaaaagaacagctaactgaatttaatcaagtctttaacttcagtctataagaaattcagaagttgagggaaacttgaatagcacctcaagccaaatctagaatgtaggaatctaatttagtcaataagtccgtggcagagagaaaagaggagataggaggaactgttctagattacaagatacaaggctgaagtacaataaaatgaaacctgtttaaatcataaatattatatatgctatgatttcatataatcatatattctactagttcagttaatcatggaataagtgaaaagagatattttagataaccagaggaatgtaaatatggagcagatactggatgatagtaagtattaagtagttattgtaaatttgtggatacgtaagaaaatggttttttctctcttcctctctttgcctaccactttcacgctttctctctccctctgactccgtctttttcactttgaaaagcttgctaaagtattaggagtgaaaggacatgctgcatggtattgacttcgaaacgctccagtaaaacagagagagattgggaaatgtatagatgaggaagtacgtaaaataatgatggtgttcaaagctcaatgattggctcataaaaatgttcataataaatgtattttttaaatgaaatgcctttgaaggtatgtgggaacataataactataagaaagacaaagtatacacatgctttttggtgatattgtaggtagctaggtatcagtatttttattgtacttatgccctacagctaaaataattatattgaaatacatcaccatatcctgtcatgttgaaatggcatagtgccacagtaacaaaaaatttcattcaaagtttatatttaggatatgtatttgttctatcttagaactgttgtgaaaaaacatgagacaagatgctgtataatagacgagcagatggcacctttctgtctacctctcttcctctttctctctctctctcccccatttctcagtgttggagcactgattattagttacctagagtactttcctctttctcaccaataaataaaataacttttgaaattatacaattagtaaaatttatggactaattcatattttcaaaatgcttactgtaattagtttaattctgaaaacgtgtatgaaacatatgacccaattattcatcatttaactagatagcagtagaggccacactggtgtcatgggatccttggggtgttgttttgccagccagaagcctctgtggtatctttggtagagtttttactcgggccccctgggctcattccacccactcagcctggcagtctgcactcggttcatcctaccagcctgaatcccatgcctgtcaagggcgagccaagtgcagactggtgaggggtgtgtgagtgagtacagggtctggccactgtgtaaagccaggcatgccggctgcagcagggcaggcagctccaggcaccggcacggacactggctccctgcaaggctgcagctgcaccaggcataccacgaccagcttctactgtgggcaccagggaacacagtgatgctcagaagcctggagacaccaggaaccacagagctccaaagagggtgtcacagccctggcttggggagctcctatgtctgggatccccaaaggactgcagctcttccctctcttctctccttctggttgcccccacgtggcaagcaggggatgggtgtgtgtttcaaccatttgtgttacagctcttttagtcccatcttttggcaggtcttgagtttttgtcctgcatccaggaagaatgaggtgtgtggacaactgcagggtgagcaaggtgaagagctgctttattgagcaactgtacagctctcaggacacccaaagtgagtagctcctatctgcaggcaggtcatcccactgagtttgcagcatttagtggagaggagacccagagtgggcagcttctatctgcaggcaggtcgtcccatcaagttgaggagaccagaattgggtagctccttcccacagctggtagtccccacatctgtctgagtctggctgagtccaggggtttttatggacgtcagaagaagtgcatgctgattggtccatgggaggccatgggtgggcccagaaatggcactaaatggcaccataagttctcattctggtccgctgaactgacagcctggccaccaggcttcagggagtccctggtttgaaggtggggcttcaccagggacctgtccctttctacccaggagcctgtcccctgccgtcatccacagtgcccaggctgtttgttctgagggatgcctgcaggtacaagctgagccatcctcagccccttgcctcagccccccttccatgctcatcggcgagggggctaagggaggaggagcctggcatgtcagtgccatccggagcacacacacacccagccaggtcacagccacccaggctcagcctcaactttgcttcgaaatctgagtgggcaacaggatcggggagaagccagacagcaggagtaggcacttcggagcctgcagggttggggcggaggtggcttcccaggcccctaagagtgcagggatgcacaggtccacagctacaactgggttgctgcagctgcgccagggaggtcggagctccgcccgcttaactcggaagggggcggagctccaacctgttcctggctcccaccagctccctggagtgcccaccacctgccacacctcccccgctgtagctagctccttgacagccactgctccaagtggacacctctgccatcactggtatttaaaaaggagagagaaaattaaaaagaattgctactgaaccaggttgaggagatcctattcaccacaaccaaaattactatgtagcaatctaagttagtcattaaaagatcaaaataatcagtcattttctggtataaaaaattctatttagaagaagttaagtagctaaagctcataaaatagatttttaaattataaaattatttaaaactctaagacatagaagtcacataactgcaagatttaagcatgtgtctaaggcagggcttctgaaattcacataagtatatccctgcaggggtactcagctgcatgcccagaagtacagtacgtgggccacaggaaaccacagcatttctttccagaacatcaactgtacttaaaatttagtaggcaaaaaacatcatatgaaagtaacattgacacaaaatagatcagttacagaatagaatgcacactttataacatttttaaaatagaaagaatacttcaggaaaatgttgtacttcaatctaagattgctgactccccagacacctgtccaccttttctgatttcagcctggtccacacagaaagtttgagagacagcagcctaaagaaaaggctggatgcatgaaactgactctcctctttgaaaacctagaaacattcttttacagccttcacgatgataaggtccccaggactgattgtcaccaactaaaatgcacaggaggctgagatcaacaccaaaatatccactatttatagacaatgaaaactaatacaagtgtcacaatgctcagaaatccaggtgtgagtaaaatcagtgcatttggtctcagaaagctatgtagacatcaaatgttcattggaaacctctttattgattttgcatgagaaattactgtcaaacagaatagaaaaacatgaaatccatatcatcagcacattctctccatgtaagcagattacacaggagtcaaaaagttgtttgatgaacatggaatcagaacacagacgaagaggctgtttcacattatcagggaggccagtgggtttgtttgccagaaagaacaacactctgggtctattgatggaagcatcataccttcagctccatcctatggacagcccttccattgaagctaggaatatttgagtcagtggttatcctgagtagcatttgagaggcactgccaaaatttacttctcagtcacctttttctgtctttccataactgaacaactcctcacattctttctcttgtctatgccaggatactgagtggatcattgtggagttttgctgtctccatcaggtggttgttggctgttgtgagacctcagtttttgtcttctcagtttaaatgaatgtaaatggagacacacagcaaagaagatgcagcatagagcaatttattgtaaaggaaaaagaatatttggaaagtttggtgcagaatacactgcatactctgagagagagaggattcatggcaggctgctggtaaggatgagacagcaaagactggcactagggagactctatgggagtcttacatgatgattcataagtgggtgggaagaggtgttactaggaagcatgttctgggtggtcctctgggtgcacatgtgcagtagctgtacatgcttgttcatatgtcgcatgtctcattagcatcttaaatctccacctgtgtgtttggtttctgttttgttttgtggcacattctcgctctgttgccaggctggagtgcaatggcgtgatcacagctcactgcagcctctgcctcctgggtccaagtgattctcctgtctcagcctcctgagtagctgggattacaggcacccgccaccacacccagctaatttttggtatttttagtagagatgggatttcaccatgttggccaagctggtctcaaaactcctgacctcaggtgttccgtccgccttggcttcccaaagtgctagattatatgtgtgagtgtggttttactattataatgagcaaagggtcagtctgagaataggtaaaataaaaatttctctctacaggagaaatttcttactggatatagctttgcttgaatgactttgactatgatgtgaatgctgaggcttcttgggttgactgtatagtcccacggttgccgagtcccaagaacatggttactaatcacaaaggaagaaaagtgagcacgttagacactagttgagctctaatgaggatgagctgcttccatcattttgagcaatagacatctcactcacaggatactaagtaaatcctagagctcttgaaaccctcctaattgtgcacaatgacttctaaagagaccccgtctccacagccacaatatggcagactgcaacagagttgaaatgcgttgttcttcagtagtctcagcctgtgcaccccaagaaaaagaaaatccacaattcatccccttatgttagtaggttacccaatttcagtgcgtaaaatgagcaaataaaattccatattgaaataacttctaagttaacatttgagatatttagcacaatgctaaatattcattggctttcctcattctttaattctacaaacatatattgagctcattctgccacaaataaggcacaatatgcaatgttgtggcaaacacaacgataaacagaaaatgatcactgttctcagctcctcacagattagcacacatcctcagttctattgaattcccaggcatctctgtttaaatttcagctccaacatttactggatgaatacgttagaatcaggcaagtcactttaatgtctctcctcagcagtaaaatgaggatagtagtccctgtattatagagtttgttgaggattaactgtaaataattcctgcaaagctcttacctcaatgtctggtacatgacgagtaatcaacgtaagtcacctgttagttttggcagtgattttggtactaatagtgggtgttggtagtacaaatatttgcacatccaaattaatggttaacagtaactggagtgttggggttttttaatggcccctggccatatcaaagccaaatgaatgcagaattacccaaagattcacgtgtgccaaaattattgataatggaaacttaaagtaccccatatctaaaagagaaatacattgaattcccttccatgccaaagtaaaagtgaccaaatattctctctttaagaaaattgttctttccttccctaaaggtccaatttaccagaaaatattctggatagaagttgcaagttacataaaataagaaaactgaatatggaaaaataaattgttttcaatataatcaggcttcattgtgacattctgagtagagttcaagctcatatctagcgtataccttagtgaaactgagtagagcaatgcaagagcctcctacttttcaaatactatttcctcttcctggtcctgtctccccaagtgaactataaaattgcttatggaatttaaaagcagattggttttatatcttccagctcattcaaatattcacctggctttaggagccctttgagttaccctgcttggttcttaaacactggttgacacctaccactggaaagcttggctgttaactacttgaactacactttgaaaaaccaatcttggttagtttctcaagaagacagcatgcattgaaagggacaatctcagatgaagcaggaatagaggggtaaaataaaaacaagaatgcttaccactttctaatgtcctccccgcaatttgaagtaatccctgtccttttgggaatttccagttgttatctctcctaagacaattatgcaccatcgtggaaaaacagataatgctatatgtctttgtagcttttctccttgtgcataaaatgagggtgaaacacctcatcggtgtgagatagagtcagctctaaatatactgagaaaattgtgtttacacagaggccgtattgactacatctccacttctttcacctcacagaaaaggaattaggtcctgccttatgtgatctgctagtccccatcagactctacaacttggtttcttctcttgcacagatttacacaaagcaaaagcaactgtcccaatcactaccaaataggcactgtatgatacttttgtattatatatagacctaactttaaatttgccattttaatcagtggcataccagtacagtgacattagcatgcattcacattgttgtgcaaccagcaccactatccatcaccagaattttttttatcatcacagcctgaaactctagagccatctttattagtcacctctggctgctataacacagtgccacatagtaggtggctcgtaaacaacatacatttattgtgtcactgctcctggaggctggaattctgagatcaggatgctagcatggtcaggtcaggttctcgcgagggctgtcttcccaccttggagatagccacctcctctctgtgtgttcatatggttgtgcatatgctgggtttggcgggcgaggggaaaagacccctcttccttcctcttgttgttaagccagttttatcagattaggactccatccttatgacctcatttagcttaattacctcctaaaagccgtatcttcaaatacacttacattgacggttagggcttcaacatataaactggcaggggggagagaggggcacaattcagtccattacaccattaaacaataacttcctattcactctcccccagttcctagtaacttccattctacttttgtttctatcaatttgactgtttcaggtacctcacataagtagaatcacacaatatatttcctttagagactggcttatttcgcttagcataatgtcttcatacaacatccatgtcgttgtatgtatcagaacttggtttctttttaaggctgaataatactccattgaatgtatataccacattttctttatgcatccatctgtcaatggacacttgggttgtttccacctttaggctatgcttaataatgctgctgtgtacataggcatataaatatctgttcaagcccttgctatcaattcttttgggtatacacctagtagtggaattgctgcatcatatggtaattctgggtttaacttttttgaggaaacgttaaacttttcttccatagcagctaccccatttggcattcctaccaacagtgcacgagggttccaatttctccacatacttgccaacacttgtagttttccactgttgctgggtttttttaacagccatcctaatgaatgtgaagtgatatgtcactgtggtgttaatttgcatttccctaatgactaatgatgttaaacaccttttcatgtatttattgaacatttgtatttcttctttggagagatgtctaaaacatcttttgcctgtttctattggtctatatgtctgtctttatgcaagtaccatactgctttaattactgtagcactatagtaagcttagaaatcatgaagtgtgaacctttcgactttgttcttccttttcaagattgttttggctattttgggtcccttgagattccataggaatttaaggataaatttttatatttcttaaaaaaacattgagatattgataggacttgcattaaatctatagaatgctttgagtagtatgaacgtcttttttttttttttttttttttttagatggagtttcgctcttgttgcccaggctggagtgcagtgtgatagctcaccgcaacctctgcctcccaggttcaagcgattctcctgcctcagccacccaagtagctgggattacaggcatgcgccaccaccctggctaattttgtatttttagtagagacggggtttctccatgttggtcagactggtcttgaactcctgacctcaggtgatctgcctgcctcggcctcccaaagtactagaattacaggcatgaaccaccgcacccggccaaacatcttaacaatattaagtcttttgatccaagaacacagacatctttccatctacttatgccttcttcaatttctttctgcatgaataatattttagccaaatgtttccacaagctcactgcccttctgcccaggcaggtcccaaatgcagctcagcaggcttcccaggttcctcagagccctccctctgctctctccatgactcaatcaccacgggacatctcacaccagaataaagccaaggagctaaactagagggaggaactgtgcccttaacgtgatttttggctttattgtccctggctaagcttctttgtttatttgtgtgagtcagcttcacatttcctctagaattgagactgctatcaaaacaggccctgacatgttagccagcagccagtctatacataagacaatggtcctcatgactgaaagtcagaagagatgctgaagtctacaattagtgtggggctttcacaagctcttgaggccccaagacaaggggttggaatcccaggtttactactgactcactataaattacctatgtattgtctagcaggttgaatggcagcccacaaaaagatatgtcaaatcctaatttcaagaacatgtgaatgtgactttttctggaaaaaaaaagataagatatttttagatggaatgaaaagataatacgaaaaaaattttttttccaaaaaatatttatctgagatgagatcatcctagattttctagatgaggtataaatccaatgaaaagagtctttgtaagtagccaggcacagagggtcaactatcacatgttctcactcataagtaggtgctaaaaaatgtatacatatggatatagagagtgcaataatagacaatggagactcagaagggtgaatgggtgggagggaggtggatgatgagaaattagttaatgggtataatgtacttcatctgggcaatggattccctaaaagccctgacttgaccactacacattctacgcatgtaacaaaattgcacatgcactccataaatttatacatttttttaaaaaaagagtccttgcaagagacattcagggaaggcagagattgcataagccaccacaagccaaggaatgctggcagccaccagaggcaaagaacgtaatctcccctagagcttctggaggaagcacagccctgccgacagcttgatttcagacttctggcctccaaaactgtgagataataatttccagccaccaagtttgtgatcatttgttccagcagccacaggaaactaagacaccttgtttcctcattcaaaatatgaataatggacaggtgcggtggctcacacctgtaatcccagcactttgggaggccaaggcaggcagatcatttgaggtcaggagtttgagaccagcctggccaacatggtgaaaccttgtctctacaaataatacaaaaagtagccgggcgtggtggcacatgcctgtaataccagctactctggaggctgaggcaggagagtcacttgaacctaggaggcagaggttgcagtgagtcaagactgcaccattgcactccagcctggacaacaagtgcaaaactctgtctcaaaaaaatatatatatatgaataataatagtacctacttctagagttgttgtgatggttaaataaaattatcatggaaagcaagtagcatagggcctaccgctgcaaactctcaataaaaccctgattagcattacaaatggaggagtgaggcaacacaatgccgaagcttataagaaccagaggtccaggaaaatcattgtttttgcctgagacatctcccggttgatttttttttttttaaggttaaaaactacagtcattttcttgcttactgaagtccatggggtataggcaaaatatcacattctgcattccaaaaaataagtatcaagctcccatgtgtttgtgcaatgggagatggggagaaaactatatatgtaacaaacatatgaaaatgttcttaggccaccagatatagaaagcaaaaatactttgtgtgccaactgttgtgtctgtatatgcgtatgtattcgtccgttctcagattgctaatacagacatactagactgggtaatttataaggaaagagctttaatggacttacagttccacatgactggagaggcctcagaaaacttacaatcatggctgaaagcagctcttcacagggcagcaggagagagaataagtgctgagcaaagaaggaagccccttataaaaccatcagatctcaggagaactcactcactataacaagaacagcctgggggaaaccgcccccatgattccattatctccacctggtcctgcccttgacatgtggggattattacaatcaattcaaggtgatattttggggggcggggagcacagagccaaaccatagcagtgtacatttcttctggagagttcataactttcatcagattctcaaaaagagtctgtgtggaaacaatagacactggggactccgaaaggagggagggggcgaggacggcaaagcctgggaaacttcctactgggaactgtgttcactgtctgggtgacaggatcagtagaagcccaaacctcagtatcatgcagtatcctcttataagaaacctgcacatgcacccactgaatctaaaattaaaattgaaattaataaaaataataaattaataaaattctttcaaaaacactgccatgtaaaggaagttataattgctctaggaaattaacatttctaattactataataatgaacattttttatgcaacagtggatactaatgggaatttatgctattagaagattatgctgtgttaaccctaacaaaaaagaacctgtaccccccaaaaatgttaatcacttacataaaataatactgatggccttgaataaagtgcttaaggccaggctctaaaaaataaaccaggcaagtattacattcagccagggggctacctgtggctcaaaacatcattgctggagccttgcccatgacccaattccagcaatatgagatgagtctggattcgaggaagagatttgagagagaaatgaacagcaagtgccttcgacaatatagcaatctcccagttgtgtagtaacagaaagtgcatttaaacatgacctgcaaaaagttctagcaataaattccttttaaattgtttggtgaggcctctttgtggaactctaagattaattgcaataataataataaattgttgtcattgtgacccctcacattcataatcagacaaactagatagaaaatatttaacattttttctttatttaaaaggcaattattgagtaagtactacatcttggtaaccacctgacaggttcatcttgcctattgcctaaacagctgatttatcaagacagggaattgcaataaagagtttaatacatgtagagtcagctaaatgggatgctgaagttttcttactactcaaaccagcctccctgaaaattcgaagactaggtttttttttaaagatattttggtagtcagacagctaggaaatgaggaatgctgaatggtagggtgggaatgaaataataggaagtcaaagctgtccttttatgctgagtcagttcctaggtgggaaccacaagaccagatgagccagtttactggtctaggtggcaccacctgatcttcagaattcaggatctgaaaaatacctcaaacatcaatcttaggttttacagtagtggttatctataggagcaattgggagtttgaattcttgtggcctctggctgcgtgactcctaagccatcatttctaatcttgtggctaatttgttggttttacaaagacagtctggtccctaatcaagaggagaggggaggttgtttggagaatgggctttttacattcttcttttcaaaattaaattataaactcaattactcccaaagttagttcaggctacccccagcaatggacaaaggcagcttggaggttagaagcaagatcagctgattaggccagatttctttcactgtcataattttcccatgtcaaatttttctcactgtcataatctttgcaaaggcagttttaatctcccctcttgggtttcatcacacattattcttaaaggtaagaggagtgaaactactctgcagctgtctgcatgtattcacaggtgcctgggtggggtttcaagacttgcatgacaatgatgttagtactctcatccacagttttagcacagcacttcagtgagcagcagactagaagataatgagtcttaatgtcaggagtgaaagtccgagcttcagtcttctttgtagaattgatttgaaaccctgggggattcaggcaaatagctctgagaaccaatcagacatagggtcactagtagagagagatttgggtcaggttgttagaaagacaaattgggacacacacaaaagagaaaatttaaatatatcatctcatatatttttagtcagctttttagacctgagaatagatcagttgagttaaacagtagtgtcccattctaggaggtggcattgcagatgggctatgctcctataagtgatgaaggtaaacagatttttaataagagatatttctatggaaacagaagaaaaaggttaatgttaggcacaatctatccagatgtccaattcaaaacacttttagttacagaggaggaaggctgtggtaatttgacacatttttcttgactgtatcccaaggaataagctttagcttgtagggcctcagggaaaaaagaaggtagtagtccaaatccgaaatatggaagaaaaatttgtaagcattaatttggggacttgcaggccagaaagaatttcagtcagtccaaactgtagaacatatttttttaattaaaaacaatgaacaagaccaaaatctaacaacaattatactatagtttttagaaacataatttttctctctccagtctccgaattttattaaagacaaatcatggtaggactgatttacttgcaaaataagctttagttcatgtattagtccattctcacactgctaataaagacacatccaagactgaataatttataaaggaaaaaggtttaatagactcacagttcagcatggcggggaggcctcaggaaacctataatcatggtggaagggaaagcaaacacatccttattcacatggtggcagcaaggagaaggtggcagctaagcaaaagggggaaaagcctcttatagaaccatcagatcacatgagaactcactatcatgagaagactgtgagggtaaccacccccatgattcaattacctaccactgggtccctcccatgacacatgaggattatgggaactacaattcaagatgaagttttgggtgagggtacagccaaaccatatcagtccaattatacttggcccaattatttgcataaagtacagcaagaataattatttgttatatggtgatatgatttggatttgtgtccccaccctaatctcatgttgaattataatacccagtgttggagaagaggtctggtgggaagtgactggatcatgggggcagactctccacttgctattctcatgatagtgaatgagttcttatgagatctggttgtttaaaagtgtgtagcacctctcccttctctctctctttctccttctctggccatgtaagatgtgcctgcttccccttcaccttcaaccatgattaaaagtttcctgaggcctctccagcctactacaattcctacaatactacaggaattatagttcctgttacagcttgcagaaccgtgagccaattaaacctcttttctaataaattacccagtttcaggtatttatttaaagcagtgaaagaatggactaatacagaaaattaatactgggagtggggcattgctataaagatacctgaaaatgtggaagcagctttggaactggatagtgggcagaagttggaacaatttggagggctcagaagaagacaggaagatatgggaaagtttgaatcttcctagagacttattaaattgttgcaaccaaaatgccaatagtaatatggacaatgaagtccaggctgaggtggtctcagatggagatgaggaacttattgggaactggactaaaggtcactcttgctgtcctttagcaaagagactggtagcattgtgcccctgctctagggatctgtggaactttgaacttgagagagaggatttagggtatctggcaaaagaaatatctaagcagcaaagcattcaaggtctgccctggctgcttctaacagcatatggtcatatgcatgagaaaagagattatctcaaattgaaacttttcaaaggggaagcagagcataaaagtttagggaatttgcagcctgaccatgtggtagaaaagaaagattcattttcatgggaggaatatgcctaaataaagaggagccaaatattaatagccaaaacaatggagaaaatgccttgaagatgtttcagagaccttcatggcagcctctcccatcacaggcctggaggcctaggagggaggtatggtttcatgggccaggcccaggaccctgctgccttgtgcaatcttgagacactgctccctgcatcctatcttctccagctcctgctatagctaaaagggccccagataggtctcaggccactgctccagagggtgcaagccctaagccttggcagcttccacatggtgttaagtctgcaggtgcacagaagccaagagttcaggcttgggagcctccatctagatctcagagaatgtatggaaatgcctggatgtccaggcagaagtctgctgcaggggcctgcaggggcaagccctcatggagaacctctgctaggacagtgcagaggggaaatgtggtggcagggccctcatacagggtcctcaaactggagcactgcctggtggagctatgagaagagggccactgtcctctagacatcaaaatggtagatccactggcagcttgcactgtgcacatggaaaagctgcaggcactcaattccaacctatgaaatcaaccaaggaggctatatcttgcagagccacaagagtggagctgccaaaacttggctgatttctccctttgggaataggtgtacttatgaaatgcctgtaccctcattgtatcttggacataactaacttgttttttattttacataggcagaagggactttcctcatctcaaatgagacttttgactatgaacttttgagttaatgctgaaatgaattaacatttcaggggactgttgaaaagaggtgattatattttgcaatgtgagaaggacatgagatatgggaggagccaggggaagaatgatatggtttggatttgtgtccccacccaaatctcatgtcaaattgtaatccctagtgttggagtaggggcctggtacaaggtgattggatcatgtgggcagacttctcccttgctgttctcatgataatgagtgagttatcatgagatctggttgcttaaaagtgtgcagcacctcccccttctctctctgttctgccttctttgtccatgtgagacgtgtctgcttctccttcactttctgccatgactgaaagtttccagaggccttccagccatacttcctgtacagcctgtgaaacaatgagccaattaaacctcttttcttataaattatccagtttcaggtatttctttatagcagtgcaagaatggactaatccatatagactttttaaaaattggcttttctggaggtttctccataaggaatctcagattagactttttaaagccttgagcccagccgcaaatttatctgtgccttcagatgcttatatgattggatgaatatctctcctcttgagcctgggcccgtcaaaaattatttaccacaggtcaggaactctgtacagggactgtgtaaataaggtataagtccagttctcccaaggggcttttattggctctataagtcaactttgattccttcaagcagtctgtttatatctgaaagcatgtcattccaatttaagccttgataaagtagccagtgtctccaattgtgtcctgttataaaagaaagcagatccttattgcacctatgcaaataactatattgccataagttaagaaaactcacgggtagtttccaaattctgataaattaggtagagaaagaaatatttttttaatttttgttcataggagtatactttcttcaattgttaaaagctataaatagctcaaaagaaaaagttttctatactctgaaaaacagaacaaaaaagatcagcagtatgtcaagcagtaagtcataaaaaggttatttgggtcttctgttagttcagttcatgcaattaacctttgttcttcctgttgttgagccagcagtgctcctgaacagatcagctgtctacaagagtcctgaaagttttttttttttaatttcaatgacccaatctcccaagttatcaaaaacctgcactcaaaagcagctgtcagagtcttatagctgattataaactgccgtttgtaaaggatcaaaacaagataacaattatctgtggaaaacaaaaatcttagtatagccacaattaaagacaaaatcaacaaggaaatctggtcatatctgtggcacacaataatttaacataaccattattaatcataaaatatactgagacatatcagaattacaggaatcttacaaagttttgaagcacaaatttataacacatttctatgaatataactcaaagaaaattaaaaaccattttatatttgaaaatgctttctgtatgattttaatataccaaataagctgaatatgtccctttttggaattcaggggacctaattcttaaaaagttaatgaagccaaaaaagacttaatttataatttgattttggaaagtttgtcaaatatcaaagatttaaaacacttggtatcataaaatagaattccatgtcactataagtaatttctttaacaaaaatgataactcaaaaattttaaaaagacttaaacttttactcattaatagaggggagattcagctttccaaccaacaagatccaataaagacagtatgaagacaactgaatctatctcttctctctttttgccttttttctgtagttgatttaaaaggcaaaatatattttattatctcaatattacatgaaaatcttgttcaaaagagaaaatcctattttacttttgtattcacgtatgatttatgttaaacccagtttttgtttttttttgttttttttgttttgagacagagtcttgctctgtcacccaggctgcagtgcagtggcatgatctcggctcactgcaattctctgcctcccaggttcaagcgattctcctaactcagcctcctgagtagctaagactacaggggcatgccaccacactcagctaatttttgtgttgttttttttttagtagagacgggattttgccatgttggccaggctggtctggagctcctgacctcaaattatcctcccacctcagcctcccaaagtgctaggattatgggcatgagccactgctcccagcctaaacccaatttttaataaaacctcataaacaaatttatctcattttaattagtgtgtaagcataagatatggttttgacaactccattattactttataatttcttgttaaaaagcagatcaatattttaagaaaatcttgttattttgacacagagcccagttccggccctgcattttattttaatgtttcatttatgggaaaactaaataatatccttttaattttagccaatttgctcacacacagaatttctcttacaagatgaatctatcataaaccttataaacttgcttaaacttttagttctatcttctcctttattaaatttagaacaattcctaaaccctctaagctagacccaaaaaaccaaattcgtatgtgtttttgccaatagcatacaactcctatttttaagcataagcaattttagttatgtaccaggtgcagagcctaggacacaggacagaactgcagataatgtctgactctttccaactagctaagggacatggctaaatccacatgtcctcaggccttacttacgatttaaaatttggaaaatatttctaaagcaggcaagaagacacctatcaaaagtcacagaagcggtgtgtaactttaaagcctctagtaaatacagtatctgaactgcctaatttagatgaaatgtctaaattgtgaagacatttttattttattttaccaataatctttaaaactgtctttatttttcaaagcttattagagtcctgtgaactaaaaggcattaaagtttctatttttctggcaaaataatttgatttaagtgcttatttttaaaggcaattaattagagctcttttatttattttaataatgaggcatcacacatacacacaacatatatgaatacacagaagcagatctggtagaatctgctgcttttaattttttaaacagtctgggtagcaccagctaatccatcagaatgcagggtctgaaaaatacctcaaacgtcagtcttaggttttacaacagtgatgttatctataggagcaactgggaggttattatcttgtggcctttggctgcatgactcctgagctatagtttctaatcttgtgaataatttgttggttttacaaaggtcatcggatcgctaagcaagcagggagtttattttggggagaagatgtattgtctttttttcaaagttcaactataagctaaattactccaaaagttagttcaccctacccctaagaatgaacaagggcagcttggaggttagaagtgagatcagtcgatgaggtcagatttctttcactgacataattttcctatgtcagatttgtctcactgccataatctttgcaaaggcagttcatctcatgaactgaattgtgtccccccaaaaattcgtatgttgaagccctaatccccaattgtctgtgtttgaagatagggtgtttagaaagtgaaacaggtcctaagggtggtgccctaatctaataggactggtgtcctgataagaagagaagagacaccagggatgtgtgcacacagagaaaaggctatgtagggacacaggtaaaaagtggccatctgcaagcctaggaaagaggcctcataggaggccaaatcctgctgacaccttgatcttgagcttcctgactccagaactgagaatctctcttgtttaagccacctaatctgtggtattttgttatagcagctctagctatataccaaaaccattccaggtgccagttacagaggtgattaaggcaagcttctcctgaagaatggcttactggcatgaggttacattacagaccactgcaagaaatagaccccactcagcctctcatggctacttgatgagctttcacttgatatggcctggactggctgattaggttgtgcatgcaatggggctaattagaactagaactagactactgttcgcttccctcaaaacctcttttgttttgctctgttatcattttgttttgttctgttctgctttattttcagggagaaataatctcactgtcttcccaagaaaggataaatcttggcttttccgggcatggtggcacatgcatgtactcccagctactcgggaggctgaggcagaagaatcactagaacccaggaggcggaggttgcagtgagccgagattgtgccactgcactccagcctgggcaacagcagagaaactccatctcaaaaacaaacaaacaaaaaaaatattggcttttgacacccacccttcatatcacagtccgaccaaaccccaacccgttcattgtcagaactatccactcattgaatctagcatgattcattgcatccacagtaagaaatttgaggagggagattaaataaaatgcttaaatgagaagcacgtatgagatttttcagaaagctgactggagcattcacatattatcagattactacaataactgttgtataagatggtgccctgggtagcatttctgatgtcactggtttggaaggagtatatttgctttttttatagaaaatatcaatcagttttccctatcagttttgcatgaattttccttgctacaggaaacagtgatggactgctggtcagtgtgacttggaactttaaggctagacctttgaaattcaacagtttaggtccccattagtttgattttagagcaggagttaagaaatagtttgaagatgtatttttaccacacctcagctgtgagctccacaaaacagaaaggccattgctttataatttaaggctcacagagaaatatttcagggaagtagttataccatgaaatactttacaaatgttacattacagtttcatatgccaaatgaaatttgacattttcacctttgttccccttaaagagccaagtcatctcttttaatatgttgaatgtgtttagcagtgctgacattcgcaatagataacccagaccgtgaattattttacctgaaaataaagacaatttgcaggccttccttagaagaccggctattacactcaagaatgggctcaagagaatctacttctctagagaacttgaaaagccccatgggtctcaggggttttgctgccatcctgtccagggctaaaaggtcatatcctcagaaccagtcccatgattttgattgcaggtcttcatggactaatggtcctgaatcttacacagagcttaacaactgtatattagaccatattttcaacctgctcacatttcaaccatctgacctgacttcaaagggagaattattttatctagacaccatattgtgtgagtagtttttcaagtactaaaaatttgctttatcttcaaagcctgtgactatggcccttggctttgaggataatattggaagtggcttttcatgattgtactagaaccagagcaaatcttagatttattggcaattcatatatgaatccaaccattgggagaagtgtttatattcataaaatagcactctagaaaaaaaatgacaggaatattaaatgtggagacattagttaaaagatcagctgcttaccccgcacagtgtggttcagtgaaaatacagctgcatgccattttctgactgatgatgcaggaaatatgatgaccagccacgtccagcttgcaggccacttgaggtttcttcccacaatctgggagtggaagggggccacactgtctccacagcacataagccaacttctgtggctttccttcaaagcagcattccctgcttttaaatatcttgacgcaggttcaagtggagcacaggaactgctattcccgtagattctttctcccacagaatactgaaaactcatgaactcctgacttaaagtacctttcaggattttcagttatccttttgatgagtttctctgcagatattcttgaagtctcacggtgaagttttctatcagatctcattttctctcctcttgtgcacccttaatttacttatctgagttttgtaaattgtagggagaaaaagaagagctaaagtaaacttgttcatctcctaagttacttcttataactgttttaaatgcctgctttcatgtttctgacatgccatgctcttttgtctcataacaaatatttgaataactcatttcaaaacataacattgtcacctgagttttcaaaaacccttggtcagccaagctggcttttggttatttcctcacctgaccacgcctctgttccaacagggcactcatgagagaatctataacaaaacacttctttccttgactttatgaaatcacagcacaaaaacctaagaaaaaaatttaactgtggtagaatgatttatattcctttggatacatacccagtaataggacaaatgcatgatatgttcattgcagcactattcacaatagcaaagacatggaatctatctaaatgtccatcagtgacagattggataaagaaaatgtgacacacacacacacacacacacacaccatggaatactatgcaaccataaaaaaaatgagatcatgtcctttgcagggacatggatgaagctggaggccgttatccttagcaaactaacgcaggaacagaaaatcaaatattacatgttctcacttacaagtgggagctaaatgatgagaacacatggatgcatagaggggaacagcacacaccgggggctatgggagggtggagggtgggaggaaggagagatcaggaaaaataactattaaatactaggcttggtatctgggtgacaaaataatctgtacaacaaacccccatgacacaagtttacctatatgacaaacctgcacatggacccctgaacctaaaataaagttaaaactttttttaacttaaaagaagaattaatagtttcggagggctctcattctcatgtgatcagaaaaacacaaattgttccatatgctctgtttacaaagagtaagtccaagctagcaaagctttctaatcttcaaagatgatatgagagggcaggaataaacttgcactcaggcagaaccaagtagagtgatgtacccctggctgttgatcacaagacgagctactttccagtgaactgtatgagtcaggatgaagtcaccactcttctgccattttctaacttttcctttcagaaatggatttttttaagtccaggtttaaaatctagagcctcttgcaaaggttaggagatgtttgctcctattgctactccatggtgccttttcttgtgccaccgcagcctcccctagagtcaagccactcatgggtaaccaggtcttcttcttcagtcttgtattttgaagacttcattgtcatgtctccatcccttggcagccccgagtgttaaagtgattttctttctaactccacttcagtgtctctatctgtaccagactccaatcctatttttgactaggatcacttcttttctaaacccaaggactcacagccttctttaatttccatgtgtttccttgagctcagtaaagcagttgccacagatttaacgcctaaaatgacattttttccagtgaattagttataaccattaccatttgcttggtaaaaagagcccaggtctaggaattagacatgggtgcgaatcctgcctgctgtctgctggttggatagtactggacaaaccacctactttctcggagcctcagttgcaaacgtgaatgaaaacacagcatggcgagagtgcagatgaggaagtgaaatgatgcccgtgaaagcatccagttcagtaagaaccttaatttattttccttctagcagaaaagagttgcttatcctaaccccaaaaggtagtagagtagcttatttatatgaatttctctctgtgtctatttgtgaaaatcaacttgtttttggccagagatccttaacttaaaactttctattttgtgataatagactgggaagggtgagtgggggcagggggaagggtgaagagatgtggattaaagagtacaaacatgcagtaagatagagggagtaaattcaatgtttgataacagagtggcatgactatacttcataaaaatgtattgtgtttgggagatggacaccgtaaataccctgacttggtcactatgctttatatgcatgtaatggaatttctcatgttccccataaattcacacaagtaaaaaagtttttgttttgatgccagacatgtttcacaaataataaaatgcttagcttcaagtggcaagacatggctttaggaaaaggtgatttgaagcagaacacatataaacctaagggccctctgataatatttctgctgtgggctcttctttctcttgcataatgtaagccagcttctgaaatgagtagtcccaacaagtcccagggcaagagagagatgccaaagcaattacatttatggtaaattcagaaaaggaaaatgtgcacaagataggaagaaaatctctgcaggcataatttgaaggaaaggcactaggtggtctctgccagcagtcattggatgtgactagcatggagcaattagaggtggaatggatctgtttaagcaaaaatggtgtgatggctatgaggcaaagccttaaatagtgaaaaatcctataagaatcacaaaagcattcctagtatgttgcatttatatgctgcttttaatttctacaagcacttcacaatttttttatcagagtctcaaatgaattatgttagggcttatatgtaattctattctcaaatatccctatccccaaaatgtttattttaattctgcttttctcctgtatatatcattcccatcactatcaagcttcttgaaagagaaacttccatttgttgactctgttcaccttccatttttttctcagtcctcttggcaatctgtcttctaccttcattcatgaaaccacagaaactgtcctttgaaaggtctctggtgacttccttattgccaaatccaacagcctctccctaggcctcccctactggatccctctatgaaatttgacactgcagctcacccctcccaccttgaaactcttctcccaggcttctttatgatttcttcttattttctccttcttatttctagctacactttctttgctcactttcaaaaaaagtcattccctggagttcccccctcaatcttctcaaattcatttctattctttgcttgagtgagatcatgtacttctattatttcaattcttactcatacgtggttgcatcagtccaagtccagccagaagacagaaatcacaccagtaatttgaatagggacattttaatattaaaaaaaaaaaaaaaacgttggctggtaaaaggggtaaaagagggctctagggagtactgaagcagcaactccaaaaaacaataactatcattagggctgaggaatgtgagcaaggcaggaacttggaaacttagaagaactctccaacttttcccacgccaaggttgagattcaggcctcatttgatgtggtgtggctgtcatatacatgcagcttggtagtgataaagaaacttgcaggacatagcagctgctgcttatctctgagggccactcctgcgagggctgctctcttccaccccaccccacatgcccatttactggctatcacatggaaaaactgtgcatgcgtgcgcactcacacacacacacgaaaaaccttcctcctgctcagcccttccagtgtccttccagcaccctctattagcaaaattgtatccactgacaaaattgtatccactgacaaaggagaaatatctacagggtccatcttgagaatcacaaactaaggcaaaaaaggatttgaagttgaaaggcaaaatattagtagaatattagcaaaatattagtagaacagtagataagagcatatacccaaataggcatttcttaccctgacccatcttccaaatttcagacttctaggtgtctatatatagatgtcccagagacacctcaaactcagcatgccttctttattatactcatggaaacagttgtcaagagctgtaatttttatttaaaatgtctaaacacatatcttcttttgaatacatattatatatatatatatataatttggatatattatttggatacattctatcattagttcagattctcattgccaattagaactagtacccattatgacaattacataactctccacctgtctttctcataatcaccagaatttactgtctaaaacaagtttttgttctcaaaaacatttaatgatctttttgccaacagaacaaggtctaaatcccttatcttgatatttaagactcttcacaaaatggcaccaatacactgccccagtctcatttcttactacatcttgatactactgctactactactatgaaacattaacatctattgagcacataatatggtccatacactaaaacaaatatatgtataatctcatttaatactcacatcacatttatgaagcattatccttaattttaaggaaaaaaactgaggcaaaaataagttaagttaacttgcttaatgccatgcagccctactaaatggtgaaatcaaactctgggcagtctaacttcagaatatgtgcatttaaccactacattatatgtctcccgaaaaataaatgagagtagaaacacatttaacaaatgggtctaaagactcataaaaaaccacaaaatgttactgaaagaaattgcatatctaaataaatggaaaaacatcccatgttcatggatttaaaaacgtgttattgttaaatggtgatactacgcaaagtgatctacagattagatgcaatctatcaaaatctaaatggaatattttgtgaaaatagaaaaacccatcctaaaatttatatggaatctcaaaggaacctgaataatgaaaacaatcttgaacaagaaaaacaaagttggagaacccacatttcctaatttcaaaacttaatacaaagctacagtaatccaaaaaatgtgtggtacaggcataaagatagacatatagaccaagggaatccaatagattgccaagaaataagccctcacatgcaaagttaattgatttttgacaagggtgccaatatcactcaataaggaatggacagtctgttcaacaaatggtgctgggaaaactggatatccactactaatggattgaattatgtctccccaaaatttatatgttgaaatcctaatccttggtacctcagaatgtaaccttatttggaaatcaggttattgcagatgtaattaattaagatgagattattctgagtatggtgggccccaatccaatatgattggtgtcttcataaaaaggggaaatttggacaccagcacacacacaaacagaacatcaagtgaacataaaagcagaaaccagcatgatatgttaacaagccaaggaacatcaaagattgccacaaaccaccagaaactaggagagaagcatattatgtactctctttcacagccctcaggaggaaccaacctgcaaacaccttgatcttggtcttttagcctccaaaactgtcaggcaataaattgctgtagtttaatccacttggtttgtggtgctttccttcggaagccatttcaaactaatatatctacgtgcaaaaaaatgaggttgtaaaatttactttacactatacacaaaatttaattctaaatggacctaaacataagagctaaaactataaaactcagaataaaacataggggaaaatctccatggcattggaatgtcaatgatctcttaaatatgacactaaagcacaggcaacaaaagaaaacaaatagataaattggacttcatgaaagttaaaacttttgtgcatcaaaggcacaattgacagaatgaaaaggtaacccactgaataggataaaatatttacaagtcatatatctgataagggattaagatctagaatatatattttcaaaactccttaaacaaaaataaaaccacaaatgactcaattcagaaataggcaaagaacctgaataggcatttctccaaactatacaaatgctcaataaacaaatgaaaaggttttcaacatcattagtcattagggaaaagcaaatcaaaaccacaatgaaataccagtttacatccactaggatggctattacataaaccaaaaaaactacaagtgttggcaaaaatatgaagaaattggaaccattgtacattgcttgtgggaatgtaaaatggttcagctactgtggaaaacactttcatggttcctcaaaaagttaaacatagaattaccttaggacccagcaatttcattcctaggtgtatgggcaaaataattgaaaacaaggatgggaaagatatttacatgccagtgttcacagaagcattattcacagtagccaaaaagtagaaacaggccaggagcagtggctcacgcctgtaatcccagcactttgggaggcagaggtgggcagatcaagaggtcaggagatcgagaccatcctggccaacatggtgaaacgctgtctctactaaattaccaaaagttagccaggtgtggtggtgcacacctgtagtcccagctactcaggaggctgaggcagcggaatcacttgaacccaggaggtggagagtacagtgagccaagattgtgccactgcactccagcctggtgacagagtgagactccatctcaagaaaaagtaaataaaaaagtagaaacagtgcaagtatccatcaatagatgaatggatacaaatttggcatatttatatatgtatatatttatatatgtgtttattcatataaatatatatgaggtcgggcatggtggctcacacctgtaatcccagcactttgggaggccaaggtgggtggatcatgaggtcaggagatcgagaccatcctggctaataaggtgaaaccctgtctctactaaaaatacaaaaaaattagccaggcgtggtggtgcacacctgtggtcccagctacttgggaggctgaggcaggagaatcacttgaacccaggaggcggaggttgcagtgagccgagatcgggccactgcactccagcctgggggacagagtgagactccgtctcaaaaaaaaaaaaaaaaaaagaatattggccttaaaaggaaatgaagttccgatacatgctacaatgttaagttaaataagccagacacaaaatggcaaacacggtatggttccatttatatgaggtttacaaaatattatttatagtcagtagaatagacagtaccaggggttgggggagaaggggaagtagggagttattgcttaatgattaatagttgctgtttcgaattatgaaatattttagacatagatcttggtgatggttacacaacattttgaatgcacttaatgctattcaattgaacatttaaaatggttaaaataataaactttacattatgtatattttatcacaattttttaaaacagctcatgagaagatgtcaaagggctgggagactgggatggagaggaaaggagtgggacattcagtacctaggactagaatcagcagaaattgttcattcattgaggggtagggaggtgggtatgtttggtgtggcgctcaaattgccaaattgagatcttgggggattgtgtaagacacagtgaagattaaccagtgatacacactgaagaacaggcctgcaatgctgggccaaggcttgttcatctgcattctccttcgacttaagtgccgtgagcaatcccatgatacaatagaaatgtgatttggccatggcagcaccccatttaccatcacagacaattcagccaaaaaaattaacaaacaaataaatagtagctaacatttactgaccacttgcaacgtacaaacactgtgccaggcacttcgcatgcatctgtttaatcctcacaactgccctctgaggcatgatcgtcttcattttacaaaccttatgttgagccatgctatatcatgtgccattccctaaaaaatgctgtacactgtcaaacttcaatatccgtattcatttctgattcctaaggcaatagtgtccttctgtcattttactgtgtacattcaattctactcatcctccagggccccttccaatgtcatccatcctaccaagtgctccaagcccatctcacccagaacggtcatttcctcttcaggtctcacttagcatttagtctcttaagaagatgtcttcagagtaatgtctccctgatatatgtgggctccttgagaacagaagccagtttttcttagtctttgaatttctaactacaaagtgcctttcattcaaaatcactctcagaatgttgacttcctgtaaatggatgaattgagctttaaaaaggacaggaggctgaagagggaagatcgcttgagcccaggagttaaagactgtggcaagctgtgtgagctgtgaacacgccactgcagtctagcctgggcaacagagcaagaccctatctcttgaaaaaaaaaatgaggttatagggaacctcatttgtacctcctgagcagaacccagacctgcttagtctccatccagttctctttctgtgttaccctagtgtcttctgtctttccagctctgcaaataaatttgcattctaaaatcaactatagtccagaggttgggcagagtggctcacgcctataatcccagcactttgagaggccaaggcagcggatcatctgaggtcaggagttcaagaccagcctgcccaacatgatgaaaccgcatctctactaaaaatacaaaattagctgggagtagtggtgcatgattgtaatcccagctatttgggaggctgaggcaggaagattgcttgaacccaggaggtggagattgcagtgagccgagattgagccattgcactccagcctggggaacaagagtgaaactccatctaactaactaactaactaaataaataaataaataaaatcaactatagtccataaaagggagcatcttaatttttttgccacgttaaaaattcacagccagaaatattggaagtctcaagcctttcttccattcaggtcctctctgatgtcctcactagaccatcaggtgcacaaaggataggactggttcttttttaattttttgctgtatacctggtttccagcagagtgcctacgacatagcaggtacctagtaaatgttgaatgaggaatgaacccaccacttcttacttaaaagacctaaggctaccaggaggaattagcagaccatgctggctcatttgttaagctaaggctagtccctctctaacagccagttgaatcccctaccccacatctactaggctccttgacatttatgccacattccccttctcttgtacctctctgataaaaacctcctgtgttgggagctggggggccggtattaagctaagcctgacttcccttgcagacctaaagaactcctttactctctgccagaccttttcttgatccttgcccaaaaggagattatctcggtaattcctgtcacaaattatgattctccttttcctcatttttctccttcccacccattcctagccaagcactgcctcattttctaatcctgttaagtgtctctcaggattccgtgacacaattgcaatgctgtcaagccctgaaactgggcatcaaaggaataaggcctgaaaatgattgattctgccatagacatatttaatatcccgtgtcctaagtttgggcccatgtgtatgtgtgtgaactgcttcaccttcagccagaggtacagagcccatgttgaaaaaatatgaatcatcataagtgttcttgtctacatttaaaaaaaatatattattagcgtgaataaacaagtattagaatcagttctattagaattgtatccacttgtttattttaatggagttgagtttgtgagcaaaatgagagaatctgaacatgtgctggagagaagcaggtggacaggtaagaagagaagcaagtgggaatggctggatactaatcttgaggaagagctggatattaatctcatatccagctgcctaccttatcctatagtgaactcacagcatttcctctctggcacaactttttgctggaatttacacagatgtagacaattatgcctttgaaacctgaaatttggcttccaaagcagtttatcccattgtctacacagatgccacttgagtgagaatttagaaaattcaagagtctagaaaatggtatcctccatccctgccagaggccttttgagctcataacatttaaaaacaaaacaaggcactccaataggctttggtgcatatccacaggcagatttggcagacttgtcactcagtgttcctggcttgggtatgtttttttctcccccacatcctccttttccaggagcagagctgctccacatgtgagttcaaatgccagccgacataggagagtaagcttctcccctgggacccactggccatgaacctgcaagcagctgctttttcttcccaaatgtgttcagagctcctggactcaagtagagagaaaaatagtgccttgaagttgtcttcagtataaactgatactggttctctaagaagagtgtgtctgtgagttaaatggcccaagaatgaaaagaaaggcctgctcagagttctgtcaggtagctttcaggttatagacagctttagaaaaccaacacgctgcactcagataaggagatcaaataggagatttacagagtgtgccaggctcaagacagcaatagcaaaatctacctttgaccttctgggtgtttctatttcactagagaaactccatcacacatcaggaaattgattttacaaaacgtgtattttaagcttggcttcacaaattctagagagaagttcctccctggtacttatttcaaggaaggtgtagtaaaggtaaaagaaatgagagcaaatcaggtgccttctgacaaccagccaagttcattccctgtctttctagatctcctacactgagagaaggaatgcaactagttcccaaggggtcagggcaggcattttccctaattcagggttcaaatctggagtcgatgggttccaggaaaaccaacttgaaagtgcttggacatatccacttatagttttgtttgtttgtttcaaaaatgtccaccactttccttggattctcagagaaatctgtaggcaaaaccaggttaagaactgttcccctgtactctgcattatttcacattaccttgtcatcagggacagagatcctgaaagcagagccccagcagtagcagatgaagccaacctgttgcctaagtccctattgaataaggagattagtacccaccacattgattccctcctgactggcatccccaacctctactcctagaataaatgaaatatgaactactctttccaccaccaccattctgtcccagcattatttattcctttcatgatactccgtatatttcataaaaacctcctctctgcctcattgcccaccccagcaggaacaggcccaggtgggtattcttctgttgcagagactcctttccttatctactcatccaggcaaaagaaccttggttaaatcatcagttgggcccatcctggttttgtttccattcttataaggacctgaaggtattatcataatccaggactatataagggcttaaaaaggattaagatcattgactttctgtaagcatacacacctaaatagcaaactatcaagaatatccatctctgctacaggctgtgcttctgacactatcaggaagattggcgaaaccttcaagcaggaagatatgatggaagggccaggcgtggtggctcacacctgtaatcccaacactttgggaggccgaggcaggtggatcaagtgaggtcgggagttcaagaccagcctggccaacatggtgaaaccccatctctataaaaataccaaaattagcttggcgtggtggcacacgcctgtaatcccagctattcaggaggctgaggtaggataattgcttgaacctgggaggtggaggttgcagtgagccgagattgcgccactgcactccagcctgggtgacagagtgaaacttggtctcaaaaaaaaaaacaagatatgacaaaaggacatgtctctgcccagactctacttctgttgctgtttcagcttttgacactttttatcaccactcttttcccacctctaagtattgagttccttatatcagtgctaacataattgtaaagaattatccttttttccactctgcaaattttcaaaggtcaggctttatgtagagaatctttatccattacagtatttcagcaataacactgtctttcctattttgctaatactctagagtgacatttaatttatcatccaaaagcaatgctaaactatgacaataggtgtagaccaagaccattgtagccaaactgaagccaaaggtcaccatgttccgcacagaaccatgcagggctaagtggttcactcgcctccatcacatcctataactgcaacatccgcctcatattggatctctctcccgctagcatgatagtggtagaaggtgctttgaagcaggaagataataaattccaaattaagcactatctgaaaagaaaagtctcccattttactgaagtcataaactctaggctactgcctatgttgcattatcaacacattctttgccccaaccagctgcagtttggctgtttaaccatcccatgttctttagcatgtcgagtagaccatgttttaaccataataggcctgttgcctgatgtgtacagcaagtcaatacaccaagatatgaggttgcagcagagaaagagtttaattatagggccgctaaatgaggagacgggaggaaacctcaaatctgtctccccaaggagtttggggctaggatttttaagggttttggagtaggctgaagttaggaaatcattgattggtcacagagagcagcataaggtcatgggacagggagatgaagaaacaatattctcatgttgatccatttcctctgtgagggtctttaaactggctgcagtcagctgttccactggaattcaatatctgcttaagcaattcttaagcaaaaaccttatgattctaacatcagaaatcctatgtataggaacaatggagatgcaaatagtcagtgtctagtgctacagactttcagttacaaggaagtgggtcaaagtacagactgattaatattgaattataactatatttctttccagaattcttgttaagcctgtgaagatggcttcaatgttacatttaattccttgatttttctccataaattgcatacaaattcaaggtctcattcaatatgcatgtaaccaaaaagataatctatgtcttacttaatctacaccatggttgttaggagccaatgataaaatacgacatagccccacactcaaaattctttcttctttccacagatccgaaatgtggcagcaaatctctgtgtggacagcaagcatggagccaccggaacagagctgaggctggacatctgtgtcaaggatggttctgaaagaacatggtctcatgaacaggtgagtcacctcccagaagccagggcagtgggaaccagtcgggggctgatgcagacacagagggatgcagctggaacaaatctccgaatggtgcagatggtacttgtgggacctggagtgaggccgctgtatcaccaaccagctctgcagttcagtgaatcacttaatgtctctgtttatgtttcttctcagagcagttgtgatgatcagttcagataatgtacacaattatcctctaaatatgagaaaggatgggagaaatgtggattgcgaccctagtcttacttcttttcccagaatggtagtttaacagaggaagcctgtagagtgctttggaacacttccaactaaatttcatggttttaatgactctgctgttctgtgtttgtgatgtcatcttaaacttgcttttcccctgaccatgaacagatcactttacatgggcctcctgttgttgtagtagtttttaatcttacatgtgaaggatgtaagcaacagcaccccaacatggacttcaggaaatactttaaggctatgtattgcttttattgatttttgttttgtttgcttttttctatttttgggggcacatagtaggtgtatatatggggtacatgaaatgttttgatacagtcatgcaatgcataacaatcacatcatgtaaaatggtgtccatcccctcaagcatttatcctttgtgttacaaacaatccaattatattattttacttattttgaaatgtacaattaacttattattgactatagtcaccgtgttgtgctatcaaatactaggtctttttcattctttctattttttgtacccatttagcatccccacctcccactccccacctcacaccctcccactacccttgccagcctctggtaaccatccttctactatcatctccatgggttcaattgttttgatttttagatcccacaaataagtgaaaatatgcaatgtttgtctttccatacctggcttatttcacttaacataatgacctccagttccatccatgttgttgcaaatgacaggatctcgttcttctttatggctgaatagtactccattatgcataggtaccacattttctttattcattcatctattgatggacacttaggttgcctccaaattttggccattgtgaacagtgctgcatcaaacatgggagtgcaggtgtctcctcgatatactgatttcctttcttttgggtatacacccagcagtggtattgctggatcacatgatagctcaatttttagtgtgttttttttgttgttttttttgttttgttttgttttgtttttaaacggagtctcgctctgtcaccaggctggagtgcagtggcgcaatctcggctcactacaacctccgactccctggttcaaacgattctccttcctcagcctcccgagaagctgggattacaggcacacaccaccatgcccagctaatttttgtatttttttttttttttttagtagagacaggggttcaccatgttggccagaatggtctcgatctcctgacctcatgatctgcccaccttggcctcccaaagtgctgggattacaggcataagccaccacgcccagccaatttttagttttttgaggaacctccaaactgttctccatagtacctgtactaagttacattcctgccaacaatgtaaaagttttcccatttctccgtatcctcaacagcatttgttattgcctatcttttggataaaagccatttcaactggggtgagatgataactcattgtagttttgatctgcatttctttgatgatcgataatcttgggcatcttttcatatgccagtttgccatttgtatgtcttcttttgagaaatatctattaaaatcttctgccaatttttaatcaaattattaggttttttacatagagttgtttgagctccttatctattacagttattaatcccttgtcagatgggtattttgcaaatattttctcccattctgtgggttgtctcttcactgtgttgattgtttcctttgccgtgcagaagctttttagtttgatgtgatccaatttgtctatttttgctttggctgcctgtgcttggggggtattactcaagacattttgcccagaccaatgtcctggagagtttcctcaatgttttcttgtagtagttgtatagtttgaggtcttagatttaagtctttaatccattttaatttgatttttgtacatgacaagagatggggtcaatctactctccagagtagctgggattacaggcttctgcatgtggatatccagttttcccagcaccatttattaaagagactgtcttttccccagtgtacgttcttggtacctttgtcaaaaatgagttgactgtaggtgtgtggatttgtttttgggttctctattctgttctgtgtaagacttaattgcttttaattgaaaaacatttcattgcaactcagtttaagtgagatgtgatttctaaccctcttagaaatttgaaagtccttgcaagcagcttccctgatactgtgtcacctgtgaaagggaaaagatagtgggcaaaattgcctttgctctcttttagcgttttcgtttcttgtattttagagatggggtcttgctctgtcacccaggctggagtgcagtgatgtgatcaaagctcactgcagcctcaaactcctgggctcaagcgatcctcttgcctcagcagcctgagtagctcagaccacaggtgcataccaccaagctcacctaacccttttcactgttttaattttaaattaagaaatatttcaatagaaagctatagaaaatatcatagcagatatttatgtactcatcacactcatctcttatgaaaagcaaaaaagcaagcaagcagttcccagtaaggcgttactgcctcctatagccagattcctctggtgcccatcttgtacattaaactagaaaaggtccaccatgcccagcgcaggatgttaaagagttgtccagatgtgttgagattcacctccctcgccccacctcactgcccctccctgccctctaccacgcattacaatgcagagcatcatgatgcgaggaaaacagccacagaacaagtccacaatacaatccagagatgttcagtccatcaacagtgcctctcccctaaccactgatccaatctttgaaccctctccccacagcctcatggtattctaggaggactgtgggccttgtagccaggccaacctggattttagtttaaaccatgtggccttgtgaagttgtgaaatctttctaggccatagttcttccatcttggacagggtggttaggagaataaatcttggggcagcatcttgcacatgcagcaggtgcagagtaatatcctctccctcctgccttccttctctcaaacactcacaaatccctttatgctaataccaaattagaaacctctctcaggtccaaggcagctgggactttggcttcatttatctgttcccagcatagtcagcaaatactagttattattcactcaaatgcgccctgcatggctgggcacggtgactcgcgcctataatcccagcactttgggaggctgaggcgggtggctcacttgaggtcaggagttcgagaccagcctggctaacattttgaaaccccgtctctactaaaaatacaaaaatcagccaggcgtggtggctgattatatacatatatccagaggggtttatagaaggctctgtgactcccagatttattgataggaatcaaatatcagtgaaaagttatttgcctcctccttcctctgtctgtttctataagctccatggggatgttactggggacctgaggaatggtgttggactgttaactccaacaagcaattctgacttcagcctgggagcaagagagaaggctttagaagctatcggtaaggctggcatctagagtggaaaagaacttttttaaaaagaaaaaggaggaaaccataaggaaaagcttcatttcttgggctaaattcctctctaccatctctattcaacccaactaagaaacacacatggccagctggtgaatataaagcaggccttaatgtctgaactgggcttagtatttctatccagtaatgctctagaatgaaatcttctctggcctgcagattttatttgacagcggaacatggatataaacaaaggcaacgatattgcatacactttaaaaattgctggttcactccccgcaccccccacgtcccccaactccccacctcccacccccaggctaaaatgcaaaaatctatggcccgtaattcaagaaatggtcaccagagggcagcactagacaagcagaaaactacataggcagaacagaaagaccagttaatacagctctttaaaaagatttcctgtctctagagatcctaaaaatgaagctacagtaggattaaataaggttgataagtggtggaaaatgcatcatgtttgaaatattgccatatattgacttggaggttaaaacattacaagctgtttcattcaccagtaattaactgtaagctttattcaatatatcactcagtgacttacaagaattaggaagcactcttctacatttagattaaaattcctgcatgaggaaggcatatcggaacatgacaattatggattttctttttaattcaaaaacattcaaaaaacacaaaaggagacttattagagttgaaataatccgtttttttccaaaaaaaaaagtggcaaaaattaaaaaaaggaaaaaacaaaattgttacatgggaaataaaaaagagtccattgaaggacctgtataagaaaatgccttctgctgcagaacactggtggtgactaacgtggtttctgtgaaggaagcaaatgtatgattcattttgccagggcaatctgcatagctgtttgatatcatggtagcattatgcttcctttagggatcaagaaagaaaaacaaaaatagatcctaataagactataaggtctggaaagaacattccccagctcccattgagtccaagggagaggagtggcggggaggaacccccttggtctagtttggctgttcccactctgcaggcccagcagcaggctctgatgtcatgctggggagcaagtgttgcagcccagctttcgtcctcccgaggaagcaaacactggctccctctccagggcctaggggaaggttcacaaagacagaagcaagcaaatgtgtgcatccaggggacagatttttttcctttcttttttctctctttgggaaaaaagagtctcattatcaagacagagcgaactgatgggtgcaaactgcaaggagaaacatgctgtatctcaggtttctgcaaacctcataacaatgaaataaaacatcacaatccagacagagaaaaatattttctgctgtctcaagtcaggtagcaagagcaagagataagtgtattggcagtaccaaatccagtgaccttattcatataatacaaacggacccaggcaacatgacacatatcacattaatattaaagcaaagaaataagagttaacattgtgatatggtttggctgtgtccccaaatctcatcttgaattgtagttcgcataatccccatgtgtcatgggagggacccagtgggaggtaatttaatcatgagggcagttaccttcatgctgttttcctgatagtgactgagttctcataagatctgatggttctataaggcgcttttcccccttttgtttggcactgctccttgctgccgccatgtgacgatggatgtgtttgcttcctcttctgccatgattgtaagtttcctgaggccttcccagccatgctgaaatgtgaatgaattaaacatctctcatttataatttactcagtctcaggtatgtctttattagcagcatgagaacagactaatacagtaaattgatactggtagggtagggtgctgctataaggatacctgaaaatgtggcagcaactgtggaactgggtaacagacagaggttggaacagtttggagggctcagaagaagaaaggaaaatgtgagaaagtttggaacttgctagagatttggagggctcagaagacaggaaaatgcaggaaagtttggaacttcctagagacttgttaaattactttgaccaaaatgctgataatgataaggacaatgaagtccaggctgaggtggtctcagatggagatgaagaacttgttgggaactggagtaaaagtcactcttgttatgcaaagagactggtggcattttgcccctgccctagagatctgtggaactttgaacttgagagtgatgatttagggtatgtggcagaagaaatctctaagtagcaaagcattcaggaggaagcagagcacaaaatttggaaaatttgcagcctaacgatgagatagaaaaaaaaatttctggagataaattccagcctgctacagaaatttgcataattaatgagcagccaaatgttaatcaccaagacaatagggaatatgtctccagagcaaatcacagaccttcacagcagcccctcccatcacagacccagaggtctaggagtcaaaaatggtttcttgggccaggcccagggccccctgctctgtgtggcctcaggacacggtgccgtgtcccagctgcttcagctccagcatggctaaaaggtgccaaggtacagctcaggccattgattcagagggtgcaagccccaagccttagcaccttccatgtagtgttgggcctgcaggtgcacagaagtcaataattaagcttggggaacctccacctagatttcagaggatgtatggaaatgcctggctgtccgggcagaggtgtgctatagtggtgggatcctcttggagaacctctgctagggtagtgcagaagggaaatgtggggttggagcccctacacagagtccccactggggcactacctagtggatctgggagaagagggccaccatcctccagaccccagtatggtagacccactgacagcttgcaccatgcacctgaaaaagccacaggcactcaatgccagcctgcgaaagcagctgggagggggctgaaacctgtaaagccacaggggcagagctgtccaaggccatggaagcccacttcttgcatcagcataacctggatgtgagacatggagtcaaaggagatcattttggaactttaaggtttaatgactgccccactggattttggacttgcatggggcctttagtccctatgttttggccaatttctcccatatggaatggctgtgtttacccaatgcctgtacccacattgtatctaggaataaccaacttgcatttgattttacaggctcataggcggagggtacttgccttgtctcagatgagactttggacttagacttttgagttaatgttggaatgagttaagactttgggggactattggaagggcatgattgtgttttgaaatgtgaggacatgagatttggaaggggccaggggcagaatgatatggtttggctgtgtctccacccaaatctcatcttgaattgtagttcccataatccccacatgttgtgggagggacccagtgggaggtaatttgatcatgggggtggttaccctcatgttgttctcatgacagtgagtgagttctcatgagatctgatggctttataaggggcttttcccccttttgcttggcactgctccttgctgtcaccatgtgaaggaggatgtgtttgctttatcttctaccatgattgtaagtttcctgaggcctccccagccatgctgagctgtgagtcaattaaacctctttcttttataaattacccagtcttgggtatgtctttattagcagcatgagaatggactaatatacattgtaaatctatgttttaaaggatcattcaaaagaagaaagcagagaaattaacatcaacttactttaacactgaggaatttaaggttgaaaagaaatcaagggttattgtacaggaaacctgaagaaaatctacattcttctgtcaataagagcaggccaagggtgaagacaaactataaatgtcacaatgacattacccaaagcaaacaatgaatataattcaatgaatataatttcataatgtctgtttctgctttgacaagcttgcagacaggaaaatgtgccaatgaaaagactcaatgcctgattggtttgacatggccactgagataagataaatggcaataagaagtatttcaaagacctaagagagaaaaaaatgagctaatcgtaggtgtagaagaataaagtaattgatataatctgaagatgtatcaccttggatgcaggaaagtaatcaacaggtaataataataatacataaaacactgtgaaaatgacaagctaaccatcaggctacaaatgtaagcatgatcatggcactacaatacgcagaaacaagaaacagaggtcacctaaggatgccctcagatataattgtgacaataggtgaataaagttgcccaacagacagatttgccagtgtttgctgtaacacaggtattcttttggacttaactgatgcatttagtaaaatgtatgaaaaggccatctaccaaagaagggaggacttttgaggtgtgacagaagcaagacactcattttctgcaggcctgattttccctaactgactcatgagggactgtactaggtagtgattacattccctttaagctctggccttctgagtgtataaaaaccaaagacagagagatggagacagagagggaaataaatcaatcaagaccacttgttcctgcattggttggactgcctatagtacaagggaaatgtgctatttaaataaaataaagatttaatcaaagccaatggcaggtttattcgccaggaaatttctattaatttctattccaatgataggtaactgaatccagagtcatcaaagttgaaaattcaaaatataagcattatcatttgctattgttgtaattaaacagcacaaactcatttgagagactaaaaagagattcattaattttgatagttaacatataataacagataattgtgggttttatttattcaatagaaatttaattgaggatctattgtgtgtcataaattgttctgggtgctggaaacacaaaggtaaaaatgctccaagccctgcaactaaggatctcactgtctagggagggatagagaaacataagtggacaatcatgatgaaataggtaagggatggaaaggagtaagcagttcaaagaggatggcttcctggatgagtggacacttgaactgaatcttacatgacagatgagcattacctaggttggctagtgaatgtctgttttccaaccagagggatttacgtgaacacggcacagaaggaaatacacagcctggtttgtgtgagaactacagaggttttagcattgctggaacataaacttgaaggaaaggaatgtaggtggaaagaacagcaaaggccagattgtggagcgttcctaagaggtcaaagagtttgaactttattctctaggggttatgtgaaaaggttgtgagattttagattgagagggaacaaggccacacaggcctttccaacagacttccttggaggctgaggaaggcagatgtgtggtaaccaaaaaagccagtttggagatcattgcaagagctattgagagcaatggttgtgggcatagaagggaatgaacaaattccagaaatgtttataaaacaaaaatggtaagacttggtcattgattagatgaggatggtaagggagacaaaggagttaaagactccaaggttgataaagtgcatgacatgaccaccaattaaaccaaaatagaggggcaggaacaaggcagaagagaagaaaatcaattgcatttagaacatgctggatctgagatgtccatgggacatgcagctgggaaattctgcaaggaactggacataagatggatgatgagtgaccggcatactggtgagagttgaaatgagagtgtaaaagaccaaccaggggaggtgcaaggacagggtccaagagagaaccctgagcaacacctgcagtggagagatgcatgaaagagagggtggtgagacagttataggacaacagaggtgcacagtgcttcaaaatccaagagagcagtgagttctgaatagaagagagtgatcaaaatctgaatagacatttccttgagaagccattcttctctgcaggatttaaatgaatctaaaaatgtctcagtccacaattatactttaaaaactctaggaaaaaagactacacaattcatcttcatgaatttatttcaaatgtctattctaaaaaccccttgttcttctatatgaaatcttctcttttatcctgtcttccagggtaacagagtacgcagtggccatgattgagaaggtcgctgttcacatgctcgtttaggtcatttcttgagaccacttaacccagttctttgtatttgtcttcagattcctcaccacttaactatctttgttagccatccctggaattttgccaggttctctacatttcctttcctaggtggaacctaacagctgaaatatactgagggcctggtcagtgcatagtgtattatctgcatacagctcagcattgtgctttcttttatatccacagggtttccctgacagctcttttttattttgcaattcacagtttggcttcacacagccagcctgccgtaagtcctattgtaagaattacataaccttcctgggattttagaattgggagcaatcacagggctcatctagtccattttcacacttaaggatttctcctactgtacctttcaaatacccttatttgttgtacagttcaaataactcaagcaaatgctcttcccctacaggtgtgtggcttgtttgcttgttaatacattgtaaagccaacttagtgcataagtcacatttttaatataatagaatgggatggatataatagaatggtataatatgatagaatgggataatataatagaatgggatacataatagaattggagaggctggactaggataggaatgtgttggatggaatatcagagtcaattaaactcagtaaaggtaaatatcatttcatgaaacttctgtttctattggaatcaagggaggtctctgtgtgtgtgtgcatgagctgcatttcttactgtgagttacagtctaaaactttctacattgccctgcagaattactcttaccaaccctagggaaattaattggcccattcttcacttcatcaagcttagctttcctttacattaggtttttcaaggtgctagcatcaattcggctcatctctactctttgtctctttagctaatctgcaaatttgggcaaactgtgtaggatttgttccagtaacattttagctaaataaagaccgtagagtgttattaaggactttctggccaggcacagtggctcatgcctgtaatcccagcactttgggaagccaaggcgggcaaatcacctgaggtcaggagtttgagactagcctagccaacatggtgaaaccccgtctctactaaaaatacaaaaattagccaggcgtggtggcgtgcgcctgtaatcccagctactcgggaggctgaggcaggagaatcgcttgaacctgggaggtggaggatgcagtgagccgagatcgcaccactgcactccagcctgggagacagggtgagactctgtctgaaaacaaacaaacaaaaaaagactttatttctctctctgaccctcatccctctcccctctgtctttcctccctctgtcctcttactcgttctccttcaatctccttcttccatgcccctccctgcatctctttttctaccatcctctgtattttctctggtacctgattggaaactcttcatttgtgttttttggcagcctggaccaaaagtgcagctgttactgctacagcactttatgacacgtgccttttccaacacctctgttaggctgagacttagctctttttggcagatcacaaagcaggagttctacattgctaaaagacataccttcccccgcccttgcatcttctctccaaaacaaactcactgcagcttttctgctactgttgctttgctagctttttacctttggatggagagaagatattcgacccggtgagccactgcatacccggaaattctgctttgatgcgatctcacacaacagccccgttacactctatgactgtcatggcatgaaggggaaccagctctggggataccggaaggtaagagtcagtccactgtggtcattctcaaattactgtggtttaagttattcttactcagttttctttgaaaacacaccgttttaggcctggcgcagtcactcacacctgtaatcctggcactctgggaggtcgaggtgggcagatcacctgaggttggagtttgagaccagcctgaccaacatagcgaaaccccatctctactgaaaatacaaaaaaaagtcaggcgtagtgatgggtgcctgtaatcccagctactcaggaggctgaggcaggagaatcactttgagcatgggagggggagattgcagtgagccaagatcgtgccactacactccagcctgggtgacagggcaagactctgttaagaaaagaaagagagagagagaaaaggaaggaaggaaagaaggaaggaaggaaggaaggaaggaaggaaggaaggaaggaaggaaggaaggaaggaaagaaggaaggaaggaaggaaagaaggaaggaaggaaggaaagaaggaaggaaaagagagagagaaggcaggaaggcaggaagggagagagggagggagggaggaaggaaggaaggaaggaaggaaggaaggaaggaagttttgaaagttttacctagtcatacatacacatatttggctcacacatctggagatcaccagcaaaggtgaagggaaaaatcgtgtgtgtagaaaggggcaagcttttggcttcgcttgttatatgtgtggccatcacaatcagttatgattgaaaaatggctttgagccagaacaagggatgggtctaggtttaactcagaacactcccaaaaggaggaaccacatatccaataagcaaaaccacgcatacataatttttaacatcaccattcacaacacacatacacacagattgtggcatccattcattttttatgtatctcaggctcacttgcttgggacctgtctgggttaagacaatgatgtttacacaaatatttatacatctatgtagatataattgctgcaatccttatacaaaaagtgacccatttacattttcaccaaaatcctgcccaaatgtagcaaagaagaatttacttggggaatttaaaagtttcaaaaattataaagttaacagtgaatggtaggaaaaattcaaaaacatatataaagtcacattttattgagttaataaaataaagagcaattaagttattgtttgaaaatatttttattgtttccttttgacaactttttagaatactttacaaaattgcttttcaaattctttgcttttggggatagaacttggctgtcaattagcaattactccataagctccattctgccctctcaaatccatggacctgctggggccttctcagccagggataagatgccttctgtttgctttttcacactctgaggccagccttgcctcaggctataaggaaaatggaatatcccccactttattcatgaacttggccatcctgtggctgaggcaaggtcagtgtccccccaaattacagaaagctaaaggagagaagtggtggagagtcagtgtggggagagggaggactggttatgttacttgttgccttacttaataagcattctggtttccacctcttagagatgagctcctaaaactatactcatccaaaggtggacttgtttgtataagtttattctgcatcccacccccacccaaacacctggcaggttgtggctgtgtctagcaaaattacaaaacatcagttgagccgagcacagtagctcacgcttgtcatcccaacactttgggaggagaggcgggcagatcacctgaggtcaggagttcaagacaagcctggccaacatggtgaaaccccatctggactaaaaaatacaaaattagccaggcatgttggtgcatgcctatagtcccagctactcgggaggctgaggcaggagaattgcctgatcctgggaggcagaagttgcagtgagccaagatcacaccattgcactgcactccagcctgggcgacaagagcgaaactccatcccaaaaaaagcaaaaaaaaatcagttgttatatccttctacaaaacaatctagaatgaaaggagctcagaagatggtatctgattaaaaatgaagctgggggaatatcactgcaatagtaaaacctcgccgttttctttatgaaatgtataataaatgattcatcttatcaaactattttgctattcaacatgatacagcctgtgtgtggtgcaataaagtaaggttttttttaatgattatattctgacatctaaagagttactttctgcgcacatcgataaaatagctgactggccatttgcttagtatgttagtggttcctaatgaacagaacatttcttattactgtacatttatagcatgacacaccaaccactcaataatatgcaattaagccaagaaaatgcaattgtttttattagggagcttacaaaagtttacagatggataagaacaactaatacacagagctcctggggagaaaaaaaactggctgcagtggtttcaaggggaaactcttatgagctttaatattaaacctttccaggatcctaagggatttgtgaaaggaaaccactagattcaattgtgctgtggctctcttctcagctttttgtagctgttggtattgcattacttagcaaaaggttacactccatgtgtatttatatagcaagcaaggtatttatacttaatcaggaacatgcaaaggctcaaaatggaaagtttctgaaatatcacatcttggtggatgactcaggcctattcagacacacctgttttagaaaattcctcttgttttttccaagggctatgcctaaggcataaagagaaaaagcacaaagagaaatctctctggtgtgttaccttatctatttggatgcagtacttggctctgggggcttctggcagttttagatgtttttgtttgttttttgagacggagttttgctcttgttgcccaggctggggtcaatggcgtgatctcggctcactgcaacctcctttcccaggttcaggcgattctcctgcctcagcctcccaagtagccaggaccacaggcatgaccaccatgcccagataattttgtatttttagtagagacagggtttcaccatgttgaccacgctggtctcgaactcctgacctcaggggatccgcccaccttagccacccaaaatgctgggattacaggcacaagccaccgtgcccagcctggaactcccactttttataagtgccatgctcttaaggaataagatcaatatttcctaggagagttccccaatgccttggattcagtgtcactgataccagccaacccctccctcccagctacatggagatatcttggagagagaaggtggccagaagccaccttgcttgggtggatgaaagttgttttcggaccttgcttcctggtttcagcaactctcattccgcttttagttatttttagatgtggctctttgccaccacaaaaggagaaaagcatccttattctatgatgctggggctatgttcagttgaacagctgtttcctacaataacaggcacccaggaagaggaatcctgttcctggttttcttttaccaccagggggacccctgttacaagaacagtgaattgttgaggcaacctcagtaaaaatatttgtcctcacccagcatcaaacaggaaactgtctttcctcttcttcaatccccattggtcactaagatttgtcacccacttccatccccagtcattggtcactaagacttgtcacctgcccccatcagccaataactctgaaatccacccgctctttgccatttctatagccagcccctgcctggttcagtcttcacatcttacccctgggttattgcaatggcttcctaaagggctgccctgcttcctgtctttccccttccccttccccatcttccaccctgaagccagagggagatttcacaaaacctggtcatggtattcctctgtttcatgacttcatttggtttctcattgagtagaagatagagtgctttagcctctcaatactcatctggatccttcacaacctggccaacataacagccgaccatcagcccttagagttattcaggcttaatacaccccaattcatcctgaaattgtaaggggatcttgaatagttgttttgcttttatgactttcaagtgcttcaccaacataataatgataataactgagtgagataaactatggaaaacttctagcacagtttctgatcataagatttccatctgtgttggtgacaatgcactttttacactgatcatcatggcaaggtatatcctaatataccacatcattaaagcaatctctcctaggcaatattgacagttgttatccctccaaaattgagcgctatctcccatgcccttttcattttaagtaaacattttattagattatagcatatgtcttaatttgggtttccccatatatacaacctaaagtaagaattttaatgcacatggtttatttgggatatagccccaaaaattcttgacagggagtgaggaagtgaaatggaggagatatcagagccaataaagggtgcattatcaagcaagtaccaccgcaggcaattagaactcaatcctactgaagatctctggaaatggtatatagaacacacatcagggagtcaattttttggtcaggttcctgaccaaagattgactggaatggtgtataaataccccaactcccttgatacctctggcctgctgctcttacagacagaaccattcttaaggccggagaaagtccttaagcagagagatgcagtgacatccgggccagcatgcactgaaatggaaaggcctgaagggccatgctcagggtacaggcactgccaagaatccaggtgctctgcatcctcaccaacacttggtattgtcagtttctttttcttttttattctgtgattgtaaagtgatatgtttgttagccattttggatatcttatttgtgcagcacctacttgagtcttttgcccattttcaaaacatgggctgtctggctttttcacacagatttttagggattttttctatatataagtgcctcattggatgtatgcattgcaatatcttattcttgttggtgtcttgtcttttttctgtttagtggagtgtcttaatgaaagctattatttatgattcgtgggttttgtgttctgtttaggaaatcctggccttcatgtagttagtcttccaagtcatctttggaaattttattgcttaatgttctacatttcggtttataattccctgatatatctgtatatctatatagatatatataattttttgagacggactttcgctctgtcagccaagctggagtgcagtggtgtgatcttggctcccagcaatctccacctcccgggttcaagcgagactccttcctcagcctccccaagtagctaggattacaggcacatgccacccagctactttttgtatttttagtagagacggggtttcaccacgttggccaggctggtctcgaactcctgacctcatgatcccgcccacctctacctcccaatgtgctgggattacaggcgtgagccaccgcgcccagccctccctgaaatatttttatgtgtataatgtaagataagggttgattcatatacagagatagaaatagatatagatatatattgatagagacatgctattgatcaatcaccatttatttaaaagaccattttttcccactgcactgaagtgacgcttttattgtaagtcaagaggtcttatatacactggtccattgttaaatcctcaagtttttaccatgtaactaaatagtcttagccatacagaaagtaagctaataaaataaactaaattaatctaataggaagtatagccaaaaacccacaactaccatcactcttagtggtgaaatgttaaagctctcctccagagatggggaataaaatagaatgttgactataatcatgtttttcaaccttttataggatatctaatcagtgtaatcaggcaagatatagacctttaaaggaataagaattggaaaggaagaaataaaacagtccattcgtagatgtcatgttagggtatttagaaaatccaaaagattatgcagctgaagtattttaaaaatgaatagatacaattagcataggcccaagatgaaaatgaattgtttatatactagcaacaaaaaatagaaaatgaagtttaaaagtgattccatttggtcactgtgaaaagcacaaaataggaataaatcacggcaaagatgtgaaagacttttatgcagaaaactacaaagcatcactaagaaaaatcttaaaaactatagagggatccatcatgttcaaggattatgtctcaatattgtgaagatgtcagtttttaaatgatccaaacatttaatgcaaaaccaaacaaatctcaggaggcttatttgtggaaattgataacctgattccaaaatttacatggaaaatgtaagggacaagaatagctaagaaaatcttgaagaaggaaaaaaaagtactaaaacattataaaagcaccaggtatcaaaacattacaaaggtgtattattaaggcaatgtactcgcctgaggatagactgactgaggctctctagaaggtgaagcctgggtattgatattctttgaaaggtcccgagagattctaatagacagtcagatggagaatcacttttgtagctctaatttttactttctttctttaatctactcctcccttttgctctagttggaatttccccctctttctgtactcctatagcattttgtttccttctttctacttaaaacactgtatattatacatacttagccccctcacccccgccaactacctgagggcaagaactttttaaaaaatgtctatatggcctgcctaatacctaatatatgaagttcctaaataagcattcattgactggcttaaagaaccactagttcaattattgatatgagccctgccttcataaaccccaacctgtgctggataaaacttaacacatttatttgtctcaaaactacatatgcaacctcccaacgaccaaaaataaaagatttaaaattactttctttagttgctctctgggggttcttataatttaactttcataataaaggacttgcaaatagcatcaaacaggaagtacaggtaagaaggcacctgccaggctaaattgataacagtgtaaccattccattcatttaaaaagtgagtgggtggaatttttggcatctgcctacatttgactatttgttgttaacttatgatatatgccaggttttggcctctcagttcataaaatgaggatgtaccagtccacaaagatgccagatagaagggctcgaggttgttattttaaatcattctggacaggtattgatttgggaccaaaaaataaggaaagtgtatataacaagtttaacttaaaagtcatgtaattcaactctggttctgataaatgaagtcactaaaaaatcctggacatgtggtcagaggttgggcagtcacactctcccaggtcagtcctaattgccagaaagctcttccctggcctttgattaccacacagattatatttaattcattttactcaagacagatcccaaatatttgaacaaatacctgcctggtttttaatccaattaaatggcccaatttcctgccactgctctccatatgacttaatttgaacccacctccatctcctggacactcacccctaaagtactgcagatagtcttagagagtaacatgattcccagaacacaatattgtaagaatgttgtcaacaaagaaagtagaataagtttctagcaccttttgttatgagcttctagcatgctttgctgtgagcaatgtctctgttaatttagcctgagttgattgatttcctgccttaacttcacacactcagcttcttaatgagctttcagtactggagaaaaaaaatctcagtctttttctcttgctttgctaaacagacatatctctccaatcttatatctgtacaggtcatcttttacattatgttgctatccacttttttccattaaactctatcctattataattatcccaacctggatttaaacattttgattcaacttaatagcaattgaactataatttgtttcatccacagattggatcagcatccattcatgccttcatctaaattgttgatcccagtgcaaagtcaagcactgagccctctatcatacagcagaggtaacaaaatccattaatgagcatcatttggaggaagttactcaaccagataaaaattcatgtaaaattatcttctagaccaccgttctccagcttgcccataagaaaacaaaattggactcttcaaacatcttgctgaaaaccagatgcccaatgtctgcaacataccccttttggtaacagaggacttatgttatcctaagaagttgtgattcttatgcagaaaatttcagtgcaaattgaaaattcagttaccttttcaaagaagaattaggctaactctcaggaggactatacattcgccccagcaatgaagctgccttttcaataattaattctatcttcccatcctgtttttagctgtatgtctaacccagctgaaatcacttaggttgttatgaccttctaacttttgccatttcaacttagcaatattcctactgattacctaacatacttaactgccattctctgatcactccgaaatagaaaggctctgttacaactctcctggggctcttccgtaaagagaaagtctttgtgaactgaacgcctgcccagatctagactgtcaaacagaaaagaatcttgttaataggaactatgaaaaaatcaaattagtgtttgttgatcaggacaattctttcctaccaagcaggtgcggggtgggagcaggactggtagttggctcagccaagaaaagagatgaaacataactcaaagactctgtgcccggtctgtgttcttaacctctgagttacgtttcatccctaatcctagcattttgggaggccgaggcatttgagaggccaagacagatcattagagcccaggagctcaagatcagcatgggcaacatggtgaaaacctgtctctaccaaaaaaaaaaaaaaaaaagctgggcatagtggcacagacctgtggtcccagctatttgggaggctgaggcaggaggatcacatgaacctggaaggactaggctacagtgagtcatgccactgcactcctgcactccagcctgggtgacccagcaagatcctgtctcaagaaaagaaaagagagagagagagagagagagagcacaggctctggctcctgcagggcctcataatagtcactggccccactgtggatgctggctttgggaccttgggcaactttcttactatgaatttctgtttcttcatttataaaatgggaataataattccctttattatctactttagtatgtgccttagcaggttattctgatgattaaaaaaaatttaagtgcacctagagcatagcacataacaagagttcaattgatgttagccgctactataccatgcattcagcaagataacttctgatttgattttcgctctccaaatagatttgcatacagaaatagatgggctaactagtcatatttctacactgtacatttctgtactattttaactatttagttatagctaaatcttagaatatcaatttcatgagagcaggaatttttctctgctttctttcgtgcactctttccggcatctaaaacactctgtggcacataataggtacttaattcaaattcactgaatgaatgaataagtgaatctagcttcctgtttgtccacattcactatctcttcaggttgcttaagtgggtttaggtagggaaaaaaaaaagagagagagagagaaactctgggtagaatacttagcactgcttgatgcctagatacacatttgacaaatagtagctattatgttcacatgacttcatgcaggtttactgaggggagctaaagagatatggatagacggaaacaaggtgcaaaacttacgggcttattctactcatggagatttcagtacagaggggaagcggacaaatactacttaaaggaagtgtacaggataatatgagaacacaaaacactgggcactatccagatcagaagggtgaagaagccttctctgacaaactaacttctaaatggagaccgaaaagatggagacttttacctttttagataggtaaagaaagtgatggagaaaaagaccacagacatctggatcaacttgtgcaaggccctgagataagcaagatattggttttctcagaacagaaagaagccagttgaaatgcatacgtgcaacagaaaatgaactattaggttggtgcaaaagtcattgcagtttttaccattaaaagtaatacaagggctgggcgctgtggctcacgcctgtaatcccagcactttgggaggccgaggcgggtggatcacgaggtcaggagatcaagaccatcctggctaacacggtgaaaccccgtctctactaaaaatacaaaaagaattagccgggcgtggtggcggatgactgtagtcccagctactcgggaggctgaggcaggagaatggcgtgaacccgggaggcggagcttgcagtgagccgagatcgtgccactgcactccagcctcggcgacagagcgagactccgtctcaaaaaaaaaaaaaaaaagttatatacggtcagacatcccagcctgggcaacatggcaaaaccccatctctacaaaaaaatacaaaaattagctgtgtgtggtggcagcacgcatgtggtcccagctactcaggctgagagggaacgattgtttgagcctgggatgtcgaggctgcagtgagccaaggtggcgccactgtgcttcagcctgggcaacaaagtgagaccctgtctcaaaaatataaaaaaggccagacatctgtagaagcaggactacacaagaccttgtaggtcatgctaagaatttagctaagagagtgtgaagtgtttgaatggattgcagagcaggcatctaacacatcaggattgatttttttttttcatgatcccggctgctctcaggagaattgaggatagattgtgcacatcactggaccacagcccaaaaatgctggtgagaagagcagaaggagggtttgaaggtttgctgtagccagcaccgtctcagcactcacaccaaggggctctgtcagggcattaagaaacattatttcttttcttttttttttgagacggagtctcgctctgtcgcccaggctagagtgcagtggcgtgatctcagctcactgcaacctcctcctcctgggttcaagtgattctggtgcctcagcttcccaagtagctgggattacaggcatgcgccaccatgcccagctaactttagtgttttttagtagagatggggtttcactatgttggccagtctggtctcaaactcctggacctcaggagttccacccgcctcggcctcccaaggtgctgggattacaggcatgagccactgtgcccagccaagaaacattatttctgattggccaaattaaccactgatgcaggaagaccaattttctcctccagtgaggaattctagctgtcaaaaaaaaaaaaaaaaatggaaaagggtagacaaaaagactgctttgtcccttttatgcctatcaaggtgttatttgcgttctctcagatgccaacagtaaaaataggcagaaaaagcctccttgatttgtccttcttccagatggctcaaaggatagtcaaatatcaaccttgttcttctgcacaaccctaagaggtgggaaagcagatcttttaattccctgtctcatcccactcccctcctgcccactccattcactttacagatggaaaccctgaatcactgacaaactaagtgaccacaaaaggttattgtcagagataaaactaggattaaaactggtttcttaattccaagccttcattccctcatagccatattagacacaaaaggctttggacaggaaggagttctctcttacagaaacatcctcttccaatgtatactcttaaaatgaatctttctacttacatggaaattgataggagggggtaactcgagtctcccaacttgacacagaggagctaccctgagatccagtctatatctaactgctcactgggcatctaaactttgatgtctcgtaagcatctccaactcgtcatacctaaaactgaactcattatcattcccacaccaatcctgtttctctttctgcatttcttgcctgaatacagcttttcctctagacatccacctcctccctctacctcaacctccacatctcattaatcagaatgcccaatgcatttcacttctcagatcactccctgggtcacccccaactcatccccattggtctcgtttttgcatcagctgaaatctgaatcattgcggtagcctctggtggttctctcttactgtagtccaatgcctttccatccctcctccatcttcctcactgccaccctaactatagaccctgtgactcttgttcaaatctcccaatgaccattccgagatactttcatgagaagtcaatccttagcactgtaccaccatctcatcatgatgtagcccctgcctacctcttggatatcctcgtctggactttttccccttgctccagctataccatatgacttgctggtctgtggcacaagacccaacctccatcacctctgacaacatctcctcactctggcttcctcattgttctctaaccaccagggtgcatagctgcttagggcccagaccctggccattccctctgggtgggaaggtctgagactctttgcatggttaattagcttaccttctttgagactcctcagatgttaccttctcagtgagattttccctggccactcaattcaatgttcacactggccccacccctggcactccaggtccttctgaccgccttgatttttttcatgtcacctctgaacaggctatgtgtttacatactatgttcattgctcattgtctgtgcccccactgccccaacctcacccctacctctggaaaagaagctccaggagggcagggatttttgtctctttaagtttatattccaagcacctaaaatagtgcctggcaaatagcaggtgcccaatatattttttgttgaataagttgaatgcataagtatatatattattttatatattttttcatatgttcttccttaaatctagaacaacctaattcatatcctactcaccctcatctacaatctcattgacacttttttactacaaacatttctttttttttttattatactttaagttctagggtacatgtgcacaacatgcaggtttgttacatatgtatacatgtgccatgctctttttttttttttttgagttgcagtttcgctcttgttgcctgggctggagtgcaatggcgcaatctcggctcaccgcaacctccgcctcccaggttcaagcaattgtcctgcttcagcctcccgagtagttgggattacaggcatgtaccaccaggcccagctaattttgtatttttagtacagacgggatttccccatgttgctcaggctggtctcgaacttctgacctcaggtgatccgcccgccttggcctcccaaagtgctgggattacaggcatgagccaccgcgcctggcctactacaaacatttcttgtttacctattggtctcccctatgtcgtgggtcagttggtgcctcttaggttatctttccatgctctctcctcatacacaccagaaaataaaagtcacttcataaatatttgtcaaactcaactgatgtgattaatgttatcttctaggcaaaggacctaaacacatagatcagatacaagatctgatcataattgcacagaagagctcatttcagagccatagataccttctctccataaatcctttcggttaaaatgggaggtactattgcatcaatttagataaccagttgaggcagaggctaacttttgaaaattctattttgccaggacttcagaaaacacaatttggtgtcgaatagctggtctcagaccagatggttggtacattctgatttttagaactagggatgctccctgactgaaaacaaagtagtggaaagggagggaggaatcactattacttagttatttacttataggcaggacactatgccagtgattttatatctattaactctttttatcctcaaaataaatatgtgaggcatactgtcatttacatgttacagataagtaacctgaggttcagaaaattaaacaagttgtccaagattacatagcaggactgaaatttgatgaatcccctacgccacaaatccaagcactttccccatgactgttgtctctccgccccctatgtggtagtttcattcttggaatcaccttcctatatataatggactcatatacctattttactatctttgcatctttagcatttggttcttttatgaccagtgtggaatcttttctgtaactcacacattcttttagagttcagagcctacaggactatggaacctaataaagtctagcacaaacccatgagtgccacaaagtgtcacacacatgccaatcaagtccacgggcctgctacaaagaagtgcccctttcaatgagctacctggaaaggcacacctacacttgccaagggtggaccgatcgactggcattgagcattgattaggaagtagtcctggattcaaacttttgcatttcctctcaaggatttctaattttctcaggcaaaacaaaacaaaaccaaaacaaacagaaaaacacaaaaatagatggagtaggcatccaggaaaagtgggaggagtaaagggaaatgcactgctggattacactgtgaatagccagagcacaggccatgccatcctccaggactggacaaagaacaacctagttaaaagcacagaaaggacatcttctatcgtcctttagggagggttgttttagaacagcagacttgccgaaacactcagaagtctattccacaaaaaaaactgtgttcagttctgttacagccatcaatgctgtgaccactgaggtgaagggcagaggagggaaaggctgtcatagaaccaaagaccacattcaaaagacaattacttgatccactgacttaagtccaaccaggaaaagcaccaggaaagacaattagtgattcacaagctcagctgagtagaaacgtaaagatggcaatgatgtagcttagccccaaggtcaaaagtggaaaatgcttgctatgggcaaggcagagggtgctttgagaagcttcacctccgggacttgctgagcactcccaagacaagggtgagcagagctctgtctccaaccagggaacaattagtctgtggatctactgatcactgtggatggtctctagtttgacacctcgtcatttgtctctgtcactagtgacctttggaataaaatgctcattcaattttatgactaggagaggctccagagatttatctaatcccccccacctcattttactgatgaagcttctcagacatagacagatgaagggaatccaatttttcaacttttatgagaacatgaagtacaagaacagaaaacattctggatggttcagggtagtggtatatttgcatactcgacttggttcagcccaggagtacacctgtatttctcagagcatgtgttccaatatgggatttggaaaaatatgatcagttgatggttcagaaaataatgtttgaaaaaataaaatgttcagaaagtctggtttggcatttgcatgcatactgaggtacacaagctagggaagaaaagagaatagaaacatgtcctactccttttctcatttcttaactctcatgaagttatgtgttttgagggggaaattgtgctcatctggagggtccacatgagcatttttttttttttgagacagagtcttgctctgtctcccaggctggagtgcagtggcctgatctcggctcactgcaacctccgcctcctgggttcaagcgattctcctgcctccgcctcccacgtagctggatttacagatgtgcaccaccacgcctggctaatttttatatttttattagagacggggtttcaccatgttggccagactggtctcgaattcctggcctcatgtgatctgcccgccatggcctcccaaagtgctggaatcacaggcgtcagccacggtacccagccccacatgagctattgataaaggtaacaacaggaaaaaatacagatagtgaagagggggcaagaagtgcatgtgtatagaacaaagtgaattagaatgtagcaggtcacctagaatttttatgactataacagcttaagagtgctctttgaaaaactgacctaaatgtattagatccgtgtagcttcactattggttggggctgggagaatgagcatgagagatgctggggaagaagagagaagacagcgaaggagactgctgcctgaggagccacagcagcggctgggagagggcatctgggacagcaaatatctaggaccctcagaaagaagggctggcggagtgagctgcagcctgcattctccttcctcctggaagctgcttcctccaccccagaggagagggaggagagagtttctcagagtctttccctggggtcagacacgggtggaattaatgaagcaagatggaaagaaaatggcaaggagatctcaggagccctctttgtgtaaggaaagtaaaatccacaataaactcaggaaactcataaagagagcagaagagaatagcaagcctttgtattaggcacagctctttgtttacactgaaaatagaaacaggcaaactaaattgcctgcaggttgcctttctccttccttattctttcttccttcatgcagtgcttaactatgcaaacatccggatcctaaaaggacattaaatattggttgatggagtcttaaaatccaggagcaacccagaaatgtttacaaagggtgcctgagaaactcctaattctaaaagcattgcaagtttagtattcctcagataaaggtaaccagagcctgtaaaccttccctaaactaaataataaaacattacttgatcttaaaatataagcagggatttggggatgttttcttgtattattggcattatagacaacattagaggtaaaatttattactagttaggaaatttttcttttagcattaccttttccccacttaacacaattaaaagagggtgtgtgttaacagagcttgttcagataatgagcttgctcactacttaaactttctgtcctcgtggtatattttcattcactgagctgttatctgcatcatgtacctgggggcttttttaaaatgaatgttgcctcctccattttgcagaaagcaatgagaacggcagcactggaacacctgcattatatcaataaagggattgagaggagactgaagctcaagaactagcaaatttgaatttgtacattcagctattgcctgtgtgtcccttgtcccaaactcatattcatcttctgaaaagggcagctgagaacccggcacttttgactgctgcttttttttttcttttgtatttctctttcccattagagattcaatgtgagggaattatgactcttctagtcattgtgtgtgcgtgtgagcagggggtattatttactgcggactaaaatacaattttttgtgtatgtgtttcttcccagatagctacattattggttacttgccaagcaaccccatatacttactattttcaaaatttaagcagatagcaaaaagctcaccacagagcagaaaatgaatggattgcttttttaaaagaagtggatgattgaatgaataaatacatttattgtctctaattgaacctgcttgtaggccctacatagtgccaatacagcctacaaattcacattccacatgggcaactccacctgctattgtttgatttgggagctgttctatttacacaataaatatatactgaaatataaacagaaatatcttacttctgtatattttgggttgtaaccattcaccacgtattacaacagtcttttcttttcttcctcactcctccaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctagaaagaagaaaggaagaaagagtgattacctacaggttataaattaaattttagccagcatctgggtcgaaggagtcaggaataacatttcctcgatccaggaaggctggtttaaaaatttgcaaatgccatgtcaaagtaggttgttttgaagaacttcctgcatctgaagaacttggctgagaatctcaccagctgcttctgagaactcgagactagcagttcccttgctggccaagggcaaagataatttagggacttttcaaaacaactgctgagctaataaatcctagcatttctcaggtcaaatcctgcagtagtgagtagctatgaatggatcctattaactgggtgggaggggggtgaaaatggagtgcatgactgctctgacaacctgaggatatcacaggtttagaactagccaagcttaaggggtgagctgtactctttggtgccattctctgactaagaatgggttcagcaggtttaacccttaaaagtgctgcagatgatttcagagtgctcacactattctgttttttttatttttatttttaaatgagggtgcaatatctaatgtaagacttaaattacataatgaaatggacatccagtgttcccattctttcgtttatatttgccatttttttttcagagcaaagtttcttttttatgaaagttcatgctccatgaatccactgaatttctaattcagtgcccttctatgaatccagttaaaaacaaaagcaaaagcaaaaatctatgctatcaagttactccaaagaaagatttcacagaagcagcaaaaccatataagatttaggagagggacttccctgggaaatctatttttacttttctattatttttaaaatcttaaaagtctgatatttgtccagtcataatttttattaagcaaggaaatggagtgagtttgatgtaatttgtttaggagattcttaaacccaaataaatctacactccaagtgatatgtgaaaatggcttagttcacttcaattctgtttagtcagtggtgggagcttagaagtggttttatttgttcgtttgtttgggttttgcttttgttttttatttttttcttgttttttttttgtagtgttgaattaatgatgttcttttatttggaagctcataaaaggaattaccattaataaagtgtttctgacaccattttctgttaatgggacaatatttcggggatgaagaaaggaatgctccgaaaactaaatggaacacttaatccttaaagcaattttttactgttcaataatatcacattgggggaagaaaacacaggtatcaaggtggttcttgggaaaaaagaatcatgtttattatatatctctcaagtttttttggtataaaaatgttttaactttgctttctttttggtttttgtttgaagttggttttcctgttaataaaaatttatataacatcttggatctagagcattaaattttagaactgggaggactcctaggatccagtccctttacttcttcagatgaatcacaaaagcccagaaaggcccaactcctggcaaggctgatgtcttctgagccctattcctgtgttttttatcttgtactgtgttgcctcactcttacccaagctggttctggatattactgtgatttaacttgagattttcagtcactagatgagaatactatgcctccctggggatgcccactaaagtaatattcacactcagaaactttaatacagtacatgaagcctcttcttatacatgttcgtgattttttatctccctgaaacttaatgaaaatgtctagttaaacaaccaggctatagttggggaagagttatttcattatctttactgatttttcaagcattcttttgaagagctatttttttttctttttctttttgattatactttaagttctgggatacatgtggagaatgtgcaggtttgttacataagtatacacatgccatggtagttcgctgcacccatcaacccctcatctacattaggtacttctcctaatgctttccttcccctagtcccccacccactgacagaccccagtgtgtgatgttccccagtgtatgatgttcccctccctgtgtccatgtgttctcattgttcagctcccacttatgagtgagaatatgtggtgtttggttttctgttcctgtgttagtttgctgagaatgatggtttccagcttcatccatgtccctgcaaaggacatgaactcatccttttttatggctgcatagtattccatggtgtatatgtgccacattttctttatccagtctatcattgatgggcatttggattggttccaagtctgtgctattgcgaacagtgctgcaataaaagtatgtgtgcatgtgtctttatagtagaatgatttctaatcctttgggtatatacccagtaatggaattgctgggtcaaatggtatttccagttctagatccttggggaaatgccacactgtcttccacaatggttgaactaatttacactcccaccaccagtgtaaaattgttcctatttctccacatcctctccagcatctgttgtttcctgactttttaatgatcgccattctaactggtgtgagatgttatctcattgtggttttgatttgcatttctctaatgaccagtgatgatgagctttttttcatatgtttgttggctgcataaatgtctccttttgagagttgtctgttcatatcctttgcccactttttgatggggtcatttttttgttgtaaatttgtttaagttctttgtagattctggatattagccctttgtcagatagatagattgcaaaaatgttctcccattctgtaggttgcctgttcactctgatgatagttcattttgctgtgcagaagctctttagtttaattagatcccatttgtcaattttggcttttgttgccattgctttaatgttttagtcatgaagtctttgcccatgcctatgtcctgaatggtatttcttaggttttcttctaaggtttttatggttttgggtcttatgtttaagtctttaatacatcttgagttaatttttgtacaaggtgtaatgaaggagtccagtttcagttttctgcatatggctagccagttttcccaacaccatttattaaatagggaatcttttctccattgcttgtttttgtcaggtttgtcaaagatcagatggttgtagatgtgtggctttatttctgaggcctctattctcttccattggtctatatatctgttttggtaccagtaccatgctgttttggttactgtagccttgtagcatagtttgaagtcaggtagcatgaagtccttcacatccctttgtaagttgtattcctaggcattttattctctttgtagtaattgtgaatgggagttcactcatgatttggctctctattagtgatgtataggaatgcctgtgatttttgcacattgattttgtatcctgagactttgctgaagttgcttatcagcttaaggagtttttgggctgagacaatggggttttctgaatatacaatcatgtcatctgcaaacagagataatttgactccctgtcttcctatttgaataccctttatttctttctcttgcctgattgccctggccagaacttccaataataatttgaataggagtggtgagaggacatccttgtcttgtgccagttttcaaagggaatgcttccagcttttgcccattgagtatgatattggctgtgggtttgtcataaatttgaagagctatttttttaaccttctgtcacagagatattttgtataggtcaagagatctcgaagcattcaagaagcatactggagaaaatcaatagtgagaaattaacctgtgtgttgagcaattccagagagtgaatgaagatttatctcaagtgttcagacagcaatcttgttgtagaattagatgatcctataaaaattcacattatgtcattaaacagctgactgctatttacagttctatgaaagagacaaccctgggttctgtaccctgcaaagctcagattcgcaatgatcttgtaggatgctataatcatggaaagctagccataacatgtttggctctgtcctttgagaaagcctgaatatattgcattattttggtgtgacacacagaggtcaaccaagattggtctcttgatctctgaataaaataatgtaatattttggggcctatttgagggtggaaggtgagaagagggagaggatcaagaaaaataacttactggtactgggcttaatacctgggtgatgaaataatctgtacaacaaatcgccatgacacaagtttactaatataacaaacctgcacatgcactcctgaacttaaaagttttaaaaaattaaattaaattttttaaatgtaatataaaaaattaatttttaaatgtaatataaaaaaataattttttaaatgtaatataaaaaattaattttttaaatgtaatataaaaaattaattttttaaatgtaatataaaaaattaattttttaaattaaggaatgcttgagacattgaggccaaaattaaaactctaaactgtcaagcaactgttaaatgtgtgcaaataggaaacaaatagaatgaaatgaagcctcgagaacctacccctaagccaaagggcacaacattgctaataagcacatctgaggaggcatttccactccactgaaggttaagactctgtctacccaaagcaccgctactaccatgctgaaaagtagaaaactatgtatgttggtatgtttatttaacaaaggggactgaacaatcctcagaaagactctctttcctggaaataacatgatttgaaaattggacagtaggccaggcacatgggtcacacttgtaatctcagcactttgggaggccgaggcgggcggatcacgaggtcaagagatcgaggccatcctggccaacatggtgaaaccccgtctctactaaaaatacaaaaattagctgggcatggtggtgtgcacctgtagtcccagctactagggaggctgaagcaggagaatcatttgaacccaggaggcagaggttgcagtgagccgagatcgtgccactgcattccagcctggcgacagagcaagactctgtctcaaaaaaataataataataaataaaaataaattggacagtagagtactgacctacccttttatcagaatgggaggaaaaatcataatctggccttggaaattgctacttctccatcataagacatggttttgccagaataattaatttttaaaatcttttttatgtatttacaaagaaaaagctgtgctttaaagcaatcatgaactaaacataggacttacacttttttcaaggctggattaataccctggcaatagcaatgtattggcttctatgtccactggtatttacttaaaaacattaatatgatcacataactgtttttaaaagtattcactatatcagaagcttcagggagtaatgcaagttccagaattgctttatgaattgataacctaaaactttatgcaataaatgaataacagaaaatgaaaatggacctacaagcaatgaaagagtgtgttaggcccgttcttctcatgtttcttggaaaacatgaaacccatgccaacacttgacatcatttcctttaggagcaatgttttaaaagaagccaaatataaataagtaaatacctattaatattttgtgcttcttcctctcagatgaaaaacttttatttctatctttttataaatatctccataaggaaatagtaaaaaagaatgctttcttggaaaaataagctctatgaagtttatggctgacctatcaaaagagttagcgccccaggcgcagtggctcacacctataatcccagcactgtgggaagccaaggtgggaggatcacttgagcccaggagttcaagatcagcctgggcaacataatgaaacctcgcctctacaaaaaataaaaaaaattagctgggtgtcataacacatgcctataatcccagctactggggaggctgaggcgggaggatcacttgagcccaggaggttgaggctgcagtgagccatgatcgcaccactgcactccagcctaggtgacagtgagatcctgtctttaaaaaaaaaaaaaaaaattcaatcacactttgattacaaagctggctatccagcagtcatagagggccacacctgccactgtgggacattcttggcccaggatatcacacacctaaggactcagaagaaagttgatgataaggctatgccagatgtgcctttgacttcttgtcttactgcagaatctcccccagaactaggcagttcacctgaccctcccctgaagaagagtgctaggttatattttttcagaatttagaatcatcctaacaatatgacattgtgaacattgatttatccctaaaaactcatttagtaaaatgtctttaggcttgttaccctggcaggattatgaggctgcaacgcgcttccataaacacatgctggagatatgctggaaataaagcatttcttataaatcatgagaaagaatgcctcaaagggaaaatatttttaagtgattccctatgattctgggagtacatataaatggagataagtaaattgtatctctcaacatggggcatgcttcattctctcccttcacctcatcgaccagtcctgctcctgccatcattcctctcagatgacaccaccaactgtaattactctccatgtgtgaaacggtggccgaggacactgaagcgtgacaagtggccagtctttcccacactgccgacattggaagattgctctttgatttatgtctatagcctttgcttgcagaactgggagctgtttgcaactctatttggtagacttgacattgacctgaagcttttattcatagtcactcatctctgagcttgacataccagactggtgtgtctggtactgcagcctcttggcagacaacagctcaggcacatgtttgatgcttcacttcagagaaacctggaaacatttcttccatccctgctgcctgaagttgcctgcttcttcccaaagcacaatagcttcctgggctttccacaggcctctgctgtccttctttgctcatttcaacgtggttctccaactgacctcagtacagaaaggctggttatatttcagaatctttttgtcgatgagtttattctgactttactcaccttgagggggctattcataactaaacagcttaggtgctgggtttacctatgttactttatgcgtatgatttttgtcctgtgtgatttttaataatgccccttttactgtttttttaaatttttacttttattatttttgagagggagtcttgctctgtcacgcaggctggagagaagtggtgcaatcttggctgactgcagcctctgcctcccaggttcaagcaattcttgtgcctcagcctcccgagtagctggaattacaggcatgtgccaccacacttcactaatttttatatttttagtagagacatggtctcaccatgttgaccaggctagtctcgaattcctgaccccaagtgatccacctaccttggcctcccaaagtgctgggattacagacctgagtcactgcatgccagcctgtttttattttttagagacagggtcttgctctgtcgcccaggctggagtgcagtggtgcaatcttagttcactgcaacctcaaactccagggctcgggtgatcttctcgccttggcttcccaaagtgctggggttacaggtgcgcaccaccatgcctggccccttttactcttaaaagtgttctagtttcagtaacgaattaaatactcaccctatttataatccacgtgcctgtttataattcctgtaggaaagaaaatgtattttgcttattaaggcttacagtctacaagaaatcaactcgacttattccttcccttcaaacaggaccagaccaaaatcagcttcttgatgactgtgtattgcattcacacgggtctttacaagttacttaatgaaagctttgtaatcaagagttctatatccacctaaatctctttgctgaatgaagtctaatttaaatgattttttcataatttaaaaaatttatttgaaatcaatgcagtcattttatattttttcaagctcaaaacagtagatcgccaacatggcctattaaccacactattaattctcaatattatggtaaggtgtagatagatagatgatagatagatagatagatagatagatggtagatagatgatgggtggacatgctatttgcattattgcttttgtttttctaagcaattttatatgtattatctcactccacacttataacaatctctggtgtagataatattataatcctcatgaaaaaaactgaaggactcagagttaaggggcttgcaaggggctagcaagttaacagcagaatcaggactagatagattcaggccttctaatatgtagacctctgttccttccattctccatggtagtttatacctcactacagggtcattcacccagagcaaagcccatatgagttgtatggaggtacctcaaaatagcaagatcactcattccttagggacttctgtttttaaccccttaattatgtttgttcttctctgtacctgtgtgtttttgttgattttcccacaagcttattaaagtaagaactgaatccaggattagtccttcttaatgagatttctaaggtacttttaagaaaagaagtgatctattaaagctatttgcatagctctagatgacaaatccaaaagcaaatactgtgttcttggtaattatcaatgggttcagtcctcagggagaggaaaacagtcattaagcaaagaatttgcactcacttcgcagtaagactccaagctgaccttcttttaatagtcttatttctgaaaagttgtcaggcacatctcttagccatctgagactctcggtctgcactgatgtgaattctctctggcagtttttctcttctgagggtacaagttaaacatgtgtattactaggcattttggtccgtttgggctgctttaacaaaatatcatacactgggtaacttacagataataggaatgtatttcttacagttctggaggctgggaagtccaagatggaggagcaggcagattcagtgtctgctgaggccccagtttctggtttaaataaagatcacatcttctcactgtggcctcacatagtgaaaggggcaagggagctctcaggggcctctttcttaagggcactaatcccaattatgaaagctctgccttcatgacctcatcacttcctaaaaggtctccctcctaataccatcactgtggaggtcaggatttcaatatataaatttggggggtagggacacaaacatttagaatatagcaccaggtcttaccccaaatctactatatcagaatttctgggttaggccactagatacagaaaattctattatcaaagagataaataattgctttgtgccccagttcctaatttcctaccactagcaaatccaagttaattctctgacatggttgttcacaaataaacactgcagatgtctggaagaatgatcagttgtaatccgaagctattataaatttgcattgagagaaacatgcctaagaacattttatttcaaaaatcctctggcttttgttaggtcagtgatcattgaaccttagtgtttaaacacctggaggtaatgttaaaacacagattgctgggccaccccttagtgatggaaatgaggctcaagaatttacatttccaacatgttgctagatgatgctgatgccgatggtccacatttggaccacatttggagtccacattttgaaagctattggttcagaccaatggtctcaccacttcgaaaatatcttcttaaagataattttgttaatgttacatgtgtttagaaagccttagttatatttaagaggcatctattggaaatgataaaaccccaacacactcaaaattcaaacaagcgttaatttaatccaataaatatttatagctggaagaaagtttctcctataaattctttaaagcaggatcacagaatttgaagaccaagaataggcagtattatggtatcacagtaaatatcttttcaatcacttaaatttctcaattaaagtataacaaatacatcaagacccctacttgaagtgcctggtattgagtctcacattaataatctgatattattgtccctttctctaaattcctagtgaacttcattctactgtagaatagaactgaaaatcaaaagaaggcatagcatggtgaactgatttactcaatattgtttttcagtgtattagtccttctgcccccaaaccatgctttttctcaagttttgtcttgggaaaggaaacattaatttctgatggcaaataaccagccaagataatttcaaatacattgtgtaaatacagttgagctatggttccccccatctttgaaaaaatgctacaagtttaattaaaagtcttttaagtgtaacaatatctcactatgctcaactcagttcactaactttgttagaaaaaagttgcagaaggtaaggaaaagcttagaatttctgctgttttaactgtggttctctcagatttgtaactttcttttcattgaaaataaacactaagaccttctttaatggtcatttctacctcatcctctgtcttcagaaacaaaaggtaatttaatttttttcttttcagtttatttaaatttcagcctctaatggcacacacagtaaatcctccacattatttttttccaaatatttttctgttatttttgtgtatactaaggatgcatgaaagagaatgtatgggaaagggtgtttcactttactgatgtttgctattcaaatctctaccacccagaaaattgtttgttatggaatttatagtgtggttttgcaccaataatccaagccatgtgttcagattttatggtgaaaaaaaaaatgcagcagatgcaagatatcctattagggtcaaaacctagacagtgcatctcaaatcaaaaggataaaattagatgatcaggactttcagtttttgttaaagataaagggagtattgagggcctgtccaacactccctattctagtaaagaatggatgaaaggaggtgggaaagtgtctatgggtgggattgggagagagaaagaaacagccatgctttattgcttaagacaatttttttaatgtcctagaggaagcagcagggaagtgtcagagtgactgagatgtcaaagaaataatctcacaaaagaaatgctgcatttgaagcaaggagccgcttctcattaatgtctacccgctagcaaatggttagggtcagaaacatgtacattctccaaaactgccttcagttggaagacaaggatatatatatatgtatataaaggagctcaaacaagtattaaataactctgcagagtcagccattgaaatgtttaaaataaaacaatctttgggacaattcatctggacaataaatgcctctgcttgaaaaagcgtctggagttgaggttcttttattgtgaacgacaggaaggacttaactggaggaaagctaatgaccttgtttctacattcctcagacatcagtcgtctgccagaaaatcgcctatgaggttgaggcagtgacggtttaaaatggccagggagaaagtctacagagaaaatgagctgcagcttcagtggcagtttctaaaaatgttggtgaatatttccgctatggagcaaagcaacacacgttccactatctgctaccagagctaagccgctggccaagatgcaaagctctttgagaaattattctttctgttttaaaaaattcttttctatttccatcaaccccgagtaaacttcctccaagaaagttaaaacatcagatgagtgaaaatcctttggtaggaaaatcaaaggatctttcttgttggagtaaagagaaatgttagaacgggaaaatctccagtcttccctcatatcgtactttgtgtgtctcttctcccaaactaggataactgtttcaggcaacgtcagcagcttggtcttttgctctgagggtgcaacattctctctagatttatttcaataaatgtttgttgaactcacaagagtgagtttttgcattagactaaaaagtatatgcagctagggaaaaatgtctggttagttgtcaaaaaacgactgctacagtctttctttcacatttgaaattggacaaatcctcaatccctttagactttcttaggattgtgtgaaatacgataataaacatgaaattgcttcataacttgcaaagcaaaatgtaaatgaaagagtttactatttaatgaaaccctgtcctccagcagcctataatctagcaaagtgcttcttaggtagggtggccatattatttattgtgcaaccagataattttttagagtgaaatgaggtgttacttgcaattacagaggaaaagcagatgaaaataaggaccgattttcttcttaaagacattgaacaaaatactcatggacaatatgaaatattaaaatagaacccacagtcaacatgtaggggttcacaaagtaggtttgggtttgagtacttggattacttattgaaaagtcctaggccaggcatggtggcttatgcctgtaatcccagtactttgggaggccaaggcaggcagatcacctgaggtcatgttcgagaccagcctggccaacatggtgaaattccgtctctactaaaaatacaaaaattagcccaggcatggtagcgggcacctgtaatcccacctagttgggaggctaaggcaggagaatcacttgaaccctggaggcagaggttgcagtgagttgagatcaaaccattgcactccagcctgggcaacaagagtgaaattctgtctcaaaaaaaaagaaaagaaaagaaaacgaaaaatcctttgaaataatttaggcaacgtggttctattttactgtttttaagttcgagcatgaagctttatctaaaataaaattgtttgcgtgctgttatagctagattataatatctaggctattcactgcttgaaaatgtccctacaacctgtattcatcaatcatgtatcaaaataacatcataataaccagcttaatttagagtatataaataaaaaacatataaacaaggtgctttacaaaggaaatacagtcttctactctgttttgatatgcaactatatacacttaattaaaaagtaaagaaaaagtgaaagtagaattcacaaaacaattgaattgtcaaacaccttccacaatattaaaattgttattttgtaatttgctttatgtatattgccaataaaattgtgtttcacttgatgaatgaggattttggaaggagactgctgtcagggaatttagcaataaaacaaagcagtgaaaaagatattagctttttattgctaatttacttccttggctttgtattgcaccaggggtaattcctctatcaaatgtggtaataatgtctgatagacttacctgataaatgtgccccatcttcagaatgtaggacgagctgtgtttgttcaattttactgcatcctgagacaaatgaaattggggaaaagctgctatgaaatgaagctattttctacagagtttgttcttgacaagctatattgcagccccagccataataaagagacaatgactcatctggtgtatagcaaaacaatgaaaataaacaaacaaaaacaaatataaagttcctaaatgttattccagcaatagacctgtaaagagatatcagttaatctaaaatatgtatatattagatgcttaacattttttgttggatgcatgaatggatagcaggaataatgcctacttcaacgcactactttcaatatttcccataattcaacctagaaaatgaaaagcagagagagaaagagatagataaaataagaagagagggagaatgagagaggaagaaaagtaaccgagagtaaatgaaagtcttcactcaaaatcataaggaatgtatcttaactgaatattttgattgatatgatgcattgttttataattgctgctccaaggaaaaaattgaggcatgaggaaaatataccccattgggcagtgggcaggaaaaaaaaatctctgtcaaagagcacaaatcttatttacaatggacctttaatgactctaagctgctttaactcccatgtagttcccccattggaagaagattataaaagactgctctcctctttcccagctcacactgatgtttttaccccattcaaaatgagtatggtaatggcattcactaaggattatcaacatttgagaaaaataaaaaagatccaatacaagctgagaagaatacaaattatctatggagcttccattgatggaaatggcaagtatagatattaatatattacatgagtcattcgtggtagacattcatcttaatggcttagacctcaataaagctaaggcagagggacccattgtataatagttttaggactcttcactgctaatggaacaagctctaaccctttccaaaggagcctggagcaccagaatcgcggagagagaaaaaacagtggaagctgtgtatgatttcccagtatactcacatttatccacttatgagcaggaatctgtgatctgaaagctttccagagtgaaatgatttctaaaactaagcaacaagaaatgcatgaaactgagaaaggagacaagtctaaggtgaacattgggctataacacaatcataaaaggcttcagaaataactgaagaaggctgactgttcttgacctataactttacctcattttgcttgtactgctgaatcgcataaatggaaaataagcaaaagcagtggttgttgtaattactttcataatggtgacgattttgacttgatgtgaattaatattcttaaacttcttcaaggtacattgcatttggccaattcttcttattctaaatcaccacaaaagaacaaggcttaccatacatcttaacaaagctggtttttgtttttgtttctaattcctaaggtcatcaactctaattttacagaagttaagctttgttctaattggctatataatcaggggtaagtaacctaatttctataattgagggtatttattcctacattgcactgtacattgttccttacaagtagaagactatgtgattttgtagtaataataaagtcaaaaagggtgtccatgttaagctatgagaattcaatctggagaacatggagcatattttccctcacttggagggctagggtaagagtaattattggcaatgttggactgaacaaacagtacactccgtaaaaaatgagatggccaacattattaattgcataagatattggctcattcattcatcaaacgtttattggttgacactaaccatgcaagtttacaaaaacctgcaatacagcttcatggcaaagctttctcctatgaagctttttacataataaaattcagggagaaaaatagtcaaatgtatactcagtaaaccttgccagaaggctgaaaatctgtttcccaattgaaaaaccacagccagatatcatgtataaaggaaagtcattcatagtaatcttactctccctttactattgttttttaatagatgactgaagattactgagagaataagataaaaagaaaaagacagaaaatattgaatatgtttgaagtctttaacccttataaaataaaaatatccaatcatcttcactacaggaaggaaactaggaatatacatctttgggagtaaaagacacctccccttccttttcctaaatagtcccttctggctcaattagctgatagaggagagctatttcacccttgaaatcctaacaaggtggcatgggaagggcagcagtgctccattccttgttgggcccacccctggatcttgatcagggattaggggtgtcacagttaattcattcataacatataaagctccaaagtttctacatttttaactgagctaaaggaatttaaatttttcctaaaataatatcattttcactcccttgtactctgttatgctttctcagtagcacgagaagggattagagttacagttagtcctgagaattgaggataaccctggttctgatgataggacaacatcagacacgtgaaggccacccatcattgtcacaagggaacaacacagaacagatacctcagggaattcctggtgatttagtcacccacctttccccgctttgcctcttgggatctctgagctctaatggtggagaaaagggaaagagataagggtcagttcttccctttgagggaaagtcctgagaaagcagtgcacagccattgaaggtccgaggccattcgctctgtacaacacactgataaaaaacaaacctgtgaaaaataaagtctagttaactcaggcaaatgcttttgaaaaagtcaaattcaaagtctatcaaatgttaactaattaggagacaatttctctacatacagtgagcaggcttccatttgcattccctggcttcagatttctcttcaaagagacatattaaacagtgcactgatatttttcaacctggcaggaaatgtgccagctgcaccagccattggaaagggaagactattatcccaattgccaattttaaccaacccagtaagtaaatagcctgggcctaatctttataggcagttaaactgtgcagtgcttaataaatactcctgggtggctgtgttaaagcaaaacaaagaatactgctggataacaagacagctgcaaaaattaacgttagctcccagaggagataggagtttccggatcacagaagctatctgtgacaagagagatacctattacaaaagagtgattattaaagaacactttaattattattaaaagaacaataagccactgcagatacatttaaggcattctacaatcaattttaagataagtaacgttgcctgaagtacaaaagataacaaaatacaaaccccatccaaatgtatcaaagcctggcaattaacttctcattaccagaaacaaactttgtgtaaaatggctattgaagaaggatattggtccaggaaggcaataatggagtttggtgggtcagaccttgagttttctacaaaatgtatagcttcttttttcaactaagtgtaaaaatccttgccagaagcaggaaaaatctatatgctaatcatatttccaattgggctcaaactgaaggaagttaagaggagagcacaaacatgactcagagggcaaagagactgacatacacaaagaaattattaaaagattctcaaatgcccagctctgctgagtaacgaccgagaggagacatgattgtcattggaaagtgtccatagagtaaacaacagtcagagtcattactgagctgaatagaaggactaaattggggtaaaattaaggacagagagatttaaactgaatgtccgtgatgagaagggctgccagatagtgaaacatctccccagggttaaccaggagacatcctctcagaaggctttcaaaagtcaggctctaccatgaaccaaaggagcatttttccaatccaaagaaatgaaaaaaaaaatccctccttaaagagcaggattatatttttggaggggggcaggaataattatctgaggtttctcctagagaaggaaaagtctgtgttgaatcaacaagggaagctcattttagaggaggtggggacaaaggcaggaagcatgaaaaagggaatgtcaccagccagcagaaaagaggtaggaagcaacaccctgtctagactccataaaaacaatgacagacccatgactggcaaacacttctgcagtggttttgtgctgaaagtgatggcacaggcatctccctgagctcatcagcatgacgtggtttttcctagcagtagcctcaacagttggtgataacctaccatgtaaattccttgtatccttaagctaagaaataattctctaaaaaccataggaggctagtctttgtagtattttctatttttaactaatggcacttaacagagtagtggtttagaatacaagcttggcatcaagcggatctgggttcgaatttcacctcatttactgtatgactattggccctctaatatagcctttcaatgacccaaattgtcagctgaaaatggggtgataatttatacctttagcaatcagtgctcttggttgcaagaattacactggaaaacatcagcagaggaggaatttattggaaggatattagaaagctcgtagaatcaacagtagcagctgagaaaatgggtgggaattaagggaggtagagcgcgctgagccatgagcaaggctatgccacagaaactgcctggtgagggtgtcactgtatgaattgctgctcccacacactgtcagactctgctgccactggacactggatgctgttcccatcccctctgtgtcatcattatgaagtgaattctaaaagatcgctgcctcttgtttatctcacttaagattctcattcaatactgggagcacctgattggccaagcctcagccacaatgcctgtagcatagctgccaggggaacagagaaaaggtagtagctgatcctttgcatcttctttagtgtaaggcaggatgcagtgtcccatggagatttacaaagtgcatgttttcctccatataagaaagagattcgaacactggaaagccaaaactcaggacaaacatctttcctagttcacctctatgtctgcccaactttgcctacattcttcttcccctaattaaacttccaaaaaatgttcacacctaacaaaacacaatgacccttatatagtgaataaccccctcccaaacagaaaacaagacatcgattctcacaccaactggaatccaggctgtctgaatgatgttaatcactctaaggtgtataacaatctcatcttgatatccatcaaccaatgaaccaaattgtaacatgagtaactctaccttaggctgttggaaagagagaggaaagaaaaagaaaaacagcaaatatgcaagtgtctgtctaacccatatctatcaggttctgagctcagaaagtaaaacgtcggataggagatgttatttatacatttgacagtaaagaaggaaatacagataggaagaaaatcagtggtcattatatctataattggtcactaggccatagctacaattttatttcctcttccatggcccctttgctgctcagagttcttttcctagtaaggccacccaaatctttatttctgagagatataggtcctttgggggttctgcctatatagaattgtagtagccttccctattcaatgtcacctctggttgcagtagaagaaaatacctcagaatatgcccccaatgtcacaacagaagcccactttcactttgaagctcaggatcagtcaccacaaccaacaccaaatcctctattccaatggcctaaggagaccaaaatgatcatgttgtagtttccaattcagtagaaccatagttttgtttcctggaagacacactcatcccttgagtacttaaggttctagccaatagtagccagggtcaaaagactagaagcaaaaatttcaaattggtcattaggtataattatttctattccttggttccaagatacatgtattcaaactggacaaagcatcataaattggtctaagaaaataaagttggtatcagctgtatacagcaccttgaacaatgttatatcccagctggtattacaaataagtcgttaacacacatttcaacaaagtcagctgcttttgaatgatgggaaacatgtgaagaccaacaaataacaagtataaacccattaccttccttgattcactacaaagtgaattcttggtcagaagcaaagttgtgtgggatagtggtaaaattcatgattatcagaaacccaatcactaaccagaccattacccattgatcataatatttataaatccttacatcatgctgcacttctttccagacttaatagctagtatatagatactgttcagagttcttcctgctggaaggacttgccttcatcactctctcaggataaggctgagtggggctgtcattgcactacacttcacatctggcttatgccagctaggggttcagagtgctaagtcaagctcaaagcgttccctcattaaaatagtcacagagaatcaccattaggccatacacatttgctcagttgcaaaatgggttttaatagattgtaaggttgaaatggaatatgcttt
